United States Patent 12,570,711 (PLATFORMS FOR CO-STIMULATION, NOVEL CAR DESIGNS AND OTHER ENHANCEMENTS FOR ADOPTIVE CELLULAR THERAPY) - sequence listing, part 2

SEQ ID NO: 1724 - DNA, 3477 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagagcagcgccgacgacgccaagaaggacgccgccaaaaaggatgatgccaagaaagacgatgctaaaaaagacggcggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1725 - DNA, 3465 bp, Artificial Sequence
  Synthetic Polynucleotide encoding a CAR with optional accessory module(s)
atggccttaccagtgaccgccttgctcctgccgctggccttgctgctccacgccgccaggccgcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctggcggaggcggaagtggaggcggaggatctggcggcggaggctcttctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1726 - DNA, 3450 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagaaccagccagagcctgagcagctacacccactggtatcagcagaagcctggcaaggcccctaagctgctgatctatgccgcttccagcagaggcagcggagtgcctagcagattttctggcagcggctccggcaccgatttcaccctgacaatatccagcctccagcctgaggacttcgccacctactactgccagcagagcagaacattcggccagggcaccaaggtggaaatcaaaggcggaggcggaagtggaggcggaggatctggcggcggaggctctcaagttcagctccagcagtctggccctggcctggttaagcctagccagacactgagcctgacctgtgccatcagcggcgatagcgtgtccagctacaacgccgtgtggaactggatcagacagagcccatccagaggactggaatggctgggcagaacctactacagaagcggctggtacaacgactacgccgagagcgtgaagtcccggatcaccatcaatcccgacaccagcaagaaccagttcagcctgcaactgaacagcgtgacccctgaggataccgccgtgtactactgtgctagaagcggccacatcaccgtgttcggcgtgaacgtggacgccttcgatatgtggggccagggaacaatggtcaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1727 - DNA, 3447 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacccagagccctctgagcctggccgtgtctctgggacagcctgccatcatcagctgcaaggccagccagagcgtgtcctttgccggcacctctctgatgcactggtatcaccagaagcccggccagcagcccagactgctgatctacagagccagcaacctggaagccggcgtgcccgatagattttccggcagcggcagcaagaccgacttcaccctgaccatcagccccgtggaagccgaagatgccgccacctactactgccagcagagcagagagtacccctacaccttcggcggaggcaccaagctggaaatcaagaggggcggaggcggaagtggaggcggaggatctggcggcggaggctctcaggtccaactggtgcagagcggagccgaggtcgtgaagcctggcgcttccgtgaagattagctgcaaagccagcggctacacctttaccggctactttatgaactgggtcaagcagagccctggccagagcctggaatggatcggcagaatccacccctacgacggcgacaccttctacaaccagaagttccagggcaaggccaccctgacagtggacaagagcagcaacaccgcccacatggaactgctgagcctgaccagcgaggacttcgccgtgtactactgcaccagatacgacggcagccgggctatggactattggggccagggcaccaccgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1728 - DNA, 3366 bp, Artificial Sequence
  Synthetic Polynucleotide encoding a CAR with optional accessory module(s)
atggccttaccagtgaccgccttgctcctgccgctggccttgctgctccacgccgccaggccgaacagctgcgagctgaccaacatcacaatcgccatcgagaaagaggaatgccggttctgcatcagcatcaacaccacttggtgcgccggctactgctacacccgcgatctggtgtataaggaccccgccagacctaagatccagaaaacctgcaccttcaaagagctggtctacgagacagtcagagtgcctggatgtgcccaccacgccgatagcctgtacacataccctgtggctacccagtgccactgcggcaagtgtgatagcgacagcaccgattgcaccgtcagaggactgggacccagctactgtagcttcggcgagatgaaggaaggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1729 - DNA, 3459 bp, Artificial Sequence
  Synthetic Polynucleotide encoding a CAR with optional accessory module(s)
atggccttaccagtgaccgccttgctcctgccgctggccttgctgctccacgccgccaggccggacctggaaaccaccctgacacagagccctgccaccctgagtgtgtccccaggcgagagagtgaccctgagctgtagagccagccagagcgtgggcagcaacctggcctggtatcagcagaagttcggccaggcccccagactgctgatctacgacgccagcacaagagccaccggcatccccgccagattttctggcagcggctccggcaccgagttcaccctgaccatcagcagactggaacccgaggacttcgccgtgtactactgccaccagtacggcagcagccccagaacctttggacagggcaccaaggtggacatcaagcggggcggaggcggaagtggaggcggaggatctggcggcggaggctctcaggtgcaactggtgcagagcggagccgaagtgaagaaacctggggccagcgtgaaggtgtcctgcaaggccagcggctacacctttaccacctacggcatctcttgggtgcgccaggctcctggacagggactggaatggatgggctggatcagcgcctacaacggccacaccaactacgcccagatgctccagggcagagtgaccatgaccaccgacaccagcacctccaccgcctacatggaactgcggggcctgagaagcgacgacaccgccgtgtattattgcgccagagaagcctacgcctcctacggcagcggcagctactggaccgattattggggccagggcaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1730 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccggacgacgttgtgatgacccagacccccctgagcctgcctgtgacacctggcgaacctgccagcatcagctgtcggagcagccagagcctggtgcacagaaacggcaacacctacctgcactggtatctccagaagcccggccagagccccaagctgctgatccacaaggtgtccaacagattcagcggcgtgcccgacagattctccggcagcggctctggcaccgacttcaccctgaagatcagccgggtggaagccgaggacctgggcgtgtacttctgtagccagagcacccatgtgccccccctgacatttggagccggcaccaagctggaactgaagggcggaggcggaagtggaggcggaggatctggcggcggaggctctgaagtgcagctggtgcagtctggcgctgaggtggaaaagcctggggccagcgtgaagattagctgcaaggccagcggcagcagcttcaccggctacaacatgaactgggtgcgccagaacatcggcaagagcctggaatggatcggagccatcgacccctactacggcggcaccagctacaaccagaagttcaagggcagagccaccctgaccgtggacaagagcaccagcaccgcctacatgcacctgaagtccctgcggagcgaggacaccgccgtgtactactgtgtgtccggcatggaatattggggccagggcaccagcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1731 - DNA, 3432 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgatgacccagacccctgccaccctgtctgtgtctgccggcgagagagtgaccattacctgcaaggccagccagagcgtgtccaacgacgtgacctggtatcagcagaagcccggccaggcccccagactgctgatctacagcgccagcaacagatacagcggcgtgcccgccagattttccggcagcggctacggcaccgagttcaccttcaccatcagcagcgtgcagagcgaggacttcgccgtgtacttctgtcagcaagactacagcagcttcggccagggcaccaagctggaaatcaagaggggcggaggcggaagtggaggcggaggatctggcggcggaggctctcaggtgcagctggtggaatctggacctggcgtggtgcagcctggcagaagcctgagaatcagctgtgccgtgtccggcttcagcgtgaccaactacggcgtgcactgggtgcgccagccacctggaaaaggactggaatggctgggcgtgatctgggctggcggcatcaccaactacaacagcgccttcatgtcccggctgaccatctccaaggacaacagcaagaacaccgtgtacctccagatgaacagcctgcgggccgaggacaccgccatgtactactgtgcttccagaggcggccactacggctacgccctggattattggggccagggaaccctcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1732 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagaccgccagcagcctgcctgcctctctgggcgacagagtgaccatctcctgtagcgccagccaggacatcagcaactacctgaactggtatcagcagaaacccgacggcaccgtgaagctgctgatcttctacagcagcaacctgcacagcggcgtgcccagcagattttctggcggcggaagcggcaccgactacagcctgaccatcagcaatctggaacccgaggacattgccacctacttttgccaccagtacagcaagctgccctggacctttggcggaggcaccaagctggaaatcaagagaggcggaggcggaagtggaggcggaggatctggcggcggaggctctgaagtgaccctggtggaaagcggcggagacttcgtgaagcctggcggctctctgaaggtgtcctgtgccgccagcggcttcgcctttagccactacgccatgagctgggtgcgccagacccctgccaagagactggaatgggtggcctacatcagcagcggcggctccggcacctactactccgatagcgtgaagggccggttcaccatcagccgggacaacgccaagaacaccctgtacctccagatgcggagcctgcggagcgaggacagcgccatgtatttctgcaccagagtgaagctgggcacctattacttcgactcttggggccagggcaccaccctgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1733 - DNA, 3444 bp, Artificial Sequence
  Synthetic Polynucleotide encoding a CAR with optional accessory module(s)
atggccttaccagtgaccgccttgctcctgccgctggccttgctgctccacgccgccaggccgcagttcgtgctgacccagagcccttctgcctctgctgccctgggagcctctgccaagctgacctgtacactgagcagcgcccacaagacctacaccatcgactggtatcagcagcagaagggaaaggcccccagatacctgatccaagtgaagtccgacggcacctacacaaaggccaccggcgtgcccgatagattcagcggcagtagcagcggagccgatagatacctgattatccccagcgtgcaggccgacgacgaggccgattactactgcggcaccgattacaccggcggctacgtgttcggcggaggcacacaactgaccgtgacaggcggaggcggaagtggaggcggaggatctggcggcggaggctctgagcaactgaaagagtctggcggcggactgttcaagcccaccgataccctgaccctgacctgcaccgtgtccggcttcagcctgagctactacggcgtgaactgggtgcgccaggcccctggcaatggcctggaatggatcggcacaatcggcggcagcggcgacacctactatgcctcttgggccaagtccagaagcaccatcatcagaaacaccaacgagaacaccgtgaccctgaagatgaccagcctgacagccgccgacaccgccacctacttttgcgtcagatacgccaacatcggctacgagtatttcaacgtgtggggacccggcaccctcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1734 - DNA, 3459 bp, Artificial Sequence
  Synthetic Polynucleotide encoding a CAR with optional accessory module(s)
atggccttaccagtgaccgccttgctcctgccgctggccttgctgctccacgccgccaggccgcagttcgtgctgacccagagcccttctgtgtctgccgccctgggagcctctgccaagctgacctgtacactgagcagcgcccacaagacctacaccatcgactggtatcagcagcagcagggcgaggcccccagatacctgatgcaagtgaagtccgacggcagctacaccaagggcaccggcgtgcccgatagattcagcggcagtagcagcggagccgatagatacctgattatccccagcgtgcaggccgacgacgaggccggatatgtgtgcggcgctgacgacaatggcggctacgtgttcggcggaggcacccaactgacagtgacaggcggaggcggaagtggaggcggaggatctggcggcggaggctctcagagcgtgaaagagtctgagggcggcctgttcaagcccaccgataccctgaccctgacctgcaccgtgtccggcttcagcctgagcagacacgccctgacatgggtgcgccaggcccctggaaatggcctggaatggatcggagccatcgacaacgccggcaccacctactatgcctcttgggccaagtccagaagcaccatcacccggaacaccgacctgcacaccgtgaccctgaagatgaccagcctgaccgccagcgacaccgccacctacttttgcgccagagtgttctacgacatcaacagcggctactacctggacggcatggacctgtggggacctggcacacttgtgaccgtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1735 - DNA, 3441 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctacccccccacctttggcggaggcaccaaggtggaaatcaagggcggaggcggaagtggaggcggaggatctggcggcggaggctctgaagtgcaactggtggaatcaggcggcggactggtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacttcggcatggacgtgtggggccacggcaccaccgtgacagtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1736 - DNA, 3444 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtggaatccgggggaggctctgtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacgacttcggcatggacgtgtggggccagggcacaaccgtgacagtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1737 - DNA, 3441 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctccatctgcctctggcacacctggacagagagtgaccatcagctgtagcggcagcagaagcaacgtcggcggcaactacgtgttctggtatcagcaggtcccaggcgctacccctaagctgctgatctacagaagcaatcagcggcctagcggcgtgcccgatagatttgccggaagcaagagcggcagctctgccagccttgccatctctggactgagaagcgaggacgaggccgactactactgtgccacctgggatgatagcctgagcggcttcgtgtttggcaccggcaccaaagtgacagtgcttggtggcggaggcggaagtggaggcggaggatctggcggcggaggctctgaagttcagctggttgaatctggcggcggactggttaagcctggcggatctctgagactgtcttgtgccgccagcggcttcaccttcagcgattactacatgagctggatcagacaggcccctggcaaaggactggaatgggtgtcctacatcagcagcagcggctccaccatctactacgccgatagcgtgaagggcagattcaccatcagccgggacaacgccaagaacagcctgtacctccagatgaactccctgagagccgaggacaccgccgtgtactattgcgccagaggctacggcaaagcctacgatcaatggggccagggcacactggtcaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1738 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggtcacacagccacctagcatgtctgccgctccaggccagcaagtgaccatctcttgtagcggcggcaacagcaacatcgagcggaactacgtgtcctggtatctgcaactgcctggcacagcccctaagctggtcatcttcgacaacgacagacggcccagcggcatccccgatagattttctggcagcaagagcggcaccagcgccacactgggaattaccggacttcagacaggcgacgaggccgactactactgtggcacatgggactctagcctgagaggctgggttttcggcggaggcacaaagctgacagtgcttggtggcggaggcggaagtggaggcggaggatctggcggcggaggctctgaagtgcagctcgttgagtctggcggcggactgattcaacctggcggaagcctgagactgagctgtgccgcttccggcttcaccttcagcaactacgccatgaactgggttcgacaggcccctggcaaaggactggaatgggtgtccaccatcaacggcagaggcagcagcaccatctacgccgattctgtgaagggcagattcaccatcagccgggacaacagcaagaacaccctgtacctccagatgaactccctgagagccgaggacaccgccacctattactgtgcccggtacatcagcagaggactgggcgattcttggggccagggcacactggttacagtgacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1739 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggtcacacagcctccatctgtgtctggcgctccaggccagagagtgaccatctcttgtaccggcagcagcagcaatatcggagccggctatgacgtgcactggtatcagcagctccctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggcagctatgtgtttggcaccggcaccaagctgacagtgcttggaggcggaggcggaagtggaggcggaggatctggcggcggaggctctgaagttcaactggtggaaaccggcggcaacctggttcaacctggcgcttctctgagactgagctgtgccgccagcggctttagctttagcggaacagccatgcactgggtccgacaggcacctggcaaaggactggaatgggtgtccaccatcagcagcacaggcagaagcacctactaccgggacagcgtgaagggcagattcaccatctccagagacaacagcaagaacaccctgtacctccagatgaacagcctgagaggcgaggacaccgccgtgtactattgtgccagagtgtccttcgactactggggccagggaaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1740 - DNA, 3444 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggttacacagcctgcctccgtgtctggctctcctggccagagcatcaccatcagctgtaccggcaccagctctgatgtcggcggctacaattacgtgtcctggtatcagcagcaccccggcaaggcccctaagctgatgatctacgacgtgtccaagaggcccagcggcgtgtccaatagattcagcggcagcaagagcggcaacaccgccagcctgacaatttctggactgcaagccgaggacgaggccgactactactgtagcagctacaccagcagcagcacactggtgtttggcggaggcaccaagctgacagttcttggaggcggaggcggaagtggaggcggaggatctggcggcggaggctctgaagttcagctggttgaaagcggcggagcctttgttcagcctggcggatctctgagactgagctgtgccgccagcggcttcacattttccagctacgccatgacctgggtccgacaggctcctggcaaaggactggaatgggtgtccaccatctccggcagaggcagaagcaccttctacgccgatagcgtgaagggcagattcacaatcagccgggacaacagcaagaacaccctgtacctccagatgaacagcctgagagccgaggataccgccgtgtactactgtgcccggtactatcacgctggcgcctttgatctttggggccagggaacactggtcaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1741 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccggacaacatcgagctgacccagagccccgccatcatgagtgcctctccaggcgagcgcgtgaccatgacatgtagcgccagcagcagcatccggtacatctactggtatcagcagaagcccggcagcagccccagactgctgatctacgacaccagcaacgtggcccctggcgtgccctttagattttccggcagcggctccggcaccagctacagcctgaccatcaaccggatggaagccgaggacgccgccacctactattgtcaggaatggagcggctacccctacaccttcggcggaggcaccaagctggacatcaagagaggcggaggcggaagtggaggcggaggatctggcggcggaggctctcaagtgaagctccaggaatctggcggcggactcgtgaagcctggcggctctctgaagctgagctgtgccgccagcggcttcaccttcagcagctacggcatgagctgggtgcgccagacccccgacaagagactggaatgggtggcaaccatcagcagcggcggcagctacacctactaccccgatagcgtgaagggccggttcaccatctccagagacaacgccaagaacaccctgtacctccagatgagcagcctgaagtccgaggataccgccatgtactactgcgccagaggcaactgggagggctggtacttcgatgtgtggggccagggcaccaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1742 - DNA, 3468 bp, Artificial Sequence
  Synthetic Polynucleotide encoding a CAR with optional accessory module(s)
atggccttaccagtgaccgccttgctcctgccgctggccttgctgctccacgccgccaggccggacaacttcatgctgacccagccccacagcgtgtccgagagccctggcaagaccgtgaccatctcctgtaccggcagcggcggcagcatcgacaacaactacgtgcactggtatcagcagaggcccggcagcgcccctaccaccgtgatgttcgaggacaaccagaggcccagcggcgtgcccgatagattcagcggctctatcgacagcagcagcaacagcgccagcctcgtgatctccggcctgaaaaccgaggacgagggcgactactactgccagagcagcgacggctccaaggtggtgtttggcggaggcaccaagctgaccgtgctgggacagggcggaggcggaagtggaggcggaggatctggcggcggaggctctgaagtgcaactggtgcagagcggcggaggctctctgacactgtcttgtgctgcctccggcgtggtgcagcctggcagattcaccttcagcagctacggaatgcactgggtgcgccaggcccctggaaagggactggaatgggtgtccgtgatctcttacgacggcagcaacaagtattacgccgacagcgtgaagggccggttcaccatctccagagacaacagcaagaacaccctgtacctccagatgaacagcctgcggaccgaggacaccgccgtgtactactgtgccaagaccctgtccgctggcgagtggattggaggcggagccttcgatatctggggccacggcacaatggtcaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1743 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagacccctctgagcctgcctgtgtccctgggcgatcaggccagcatcagctgtagaagcagccagagcctggtgcacagcaacggcaacacctacctgcactggtatctccagaagcccggccagagccccaagctgctgatctacaaggtgtccaacagattcagcggcgtgcccgacagattctccggcagcggctctggcaccgacttcaccctgaagatcagccgggtggaagccgaggacctgggcgtgtacttctgtagccagaacacccccgtgccccccaagtttggcagcggcaccaagctggaaatcaagggcggaggcggaagtggaggcggaggatctggcggcggaggctctcaggtgcagctccagcagtctggcgctgaactcgtgcggcctggcgcttctgtgaagctgtcttgcaaggccagcggctacaccttcaacgactacgagatgcactgggtcaagcagacccctgtgcacggcctgaagtggatcggagccctggaacccaagaccggcgataccgcctacagccagaagttcaagggcaaggccaccctgaccgccgacaagagcagcagcacagcctacatggaactgcggagcctgaccagcgaggacagcgccgtgtactactgcaccagctgctactactacacctacagcggccagggcaccctcgtgacagtgtctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1744 - DNA, 3435 bp, Artificial Sequence
  Synthetic Polynucleotide encoding a CAR with optional accessory module(s)
atggccttaccagtgaccgccttgctcctgccgctggccttgctgctccacgccgccaggccggacatccaactgacccagagccccagcagcctgtctgcctctgtgggcgacagagtgaccatcacctgtagagccagccagggcatcagaaacgacctgggctggtatcagcagaagcccggcaaggcccccaagcggctgatctatgctgccagctccctccagaatggcgtgcccagcagattttccggcagcggctctggcaccgagttcaccctgaccatcagctccctccagcccgaggacttcgccacctactactgcctccagcacaacacctaccccgccttcggccagggcaccaaggtggaaatcaagagaggcggaggcggaagtggaggcggaggatctggcggcggaggctctcaggtgcaactccaggaatctggccctggcctcgtgaagcctagccagaccctgagcctgacctgtaccgtgtctggcggcagcatcagcagcttcaactactactggtcctggatcagacaccaccctggcaagggcctggaatggatcggctacatctactacagcggcagcacctacagcaaccccagcctgaagtcccgcgtgaccatctccgtggacaccagcaagaaccagtttagcctgaccctgtccagcgtgacagccgccgataccgccgtgtactactgcgccagaggctacaactggaactacttcgactactggggccagggaaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1745 - DNA, 3441 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgctgacccagagccccgccagcctggccgtgagcctgggccagagcgtgaccatcagctgcagagccagcgagagcgtggagtactacggcaccagcctgatgcagtggtaccagcagaagcccggccagccccccaagctgctgatctacgccaccagcaacgtggagagcggcgtgcccgccagattcagcggcagcggcagcggcaccgacttcagcctgaacatccaccccgtggaggaggacgacatcgccatgtacttctgccagcagagcagaaagctgcccagcaccttcggcggcggcaccaagctggagatcaagggcggaggcggaagtggaggcggaggatctggcggcggaggctctgacgtgagactgcaggagagcggccccggccaggtgaagcccagccagaccgtgagcctgacctgcagcgtgaccggctacagcatcaccaacggcaaccactggtggaactggatcagacaggtgagcggcagcaagctggagtggatcggctacatcagcagcagcggcagcaccgacagcaaccccagcctgaagagcagaatcagcatcaccagagacaccagcaagaaccagctgttcctgcagctgaacagcgtgaccaccgaggacatcgccacctactactgcgccagaggctactacttcgactactggggccagggcaccaccctgaccgtgagcagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1746 - DNA, 3075 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcaactggtggaaagcggcggaggcctggtgcaggctggcggatctctgagactgagctgtgccgccagcggcatcaccttcagcatcaacacaatgggctggtacagacaggcccctggcaagcagagggaactggtggccctgatctccagcatcggcgacacctactacgccgacagcgtgaagggccggttcaccatcagccgggacaacgccaagaacaccgtgtacctccagatgaacagcctgaagcccgaggacaccgccgtgtactactgcaagcggttcagaacagccgcccagggcaccgattattggggccagggaacacaagtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1747 - DNA, 2880 bp, Artificial Sequence
  Synthetic Polynucleotide encoding a CAR with optional accessory module(s)
atggactggatttggcgcatccttttccttgtcggcgctgctaccggcgcccattccttcgaaggcagcggattcgaatacgccaaagagatgcggaacgcctactgggagatcgccctgctgcccaatctgaccaaccagcagaagagagcccccatcagaaagctgtacgacgacccctcccagagcagcgagctgctgtctgaggctaaaaaactgaacgatagccagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1748 - DNA, 3093 bp, Artificial Sequence
  Synthetic Polynucleotide encoding a CAR with optional accessory module(s)
atggccctgcccgtgacagccctgctgctgcctctggctctgctgctgcacgccgccagacccgatgaattcggctctgacctgggcatcaagctgctgttcgccgctgccaagggccaggacgacgaagtgcggattctgctggctgctggggccgacgtgaacgccaaggatttcgagggctacacccccctgcacgtggccgcctatgatggacacctggaaatcgtggaagtgctgctgaaggctggcgctgatgtgaatgccaaagacagccagggccggacccctctgcatgaagccgcctacagcggccatctggaaattgtggaagtgctgctgaaagccggggcagacgtgaacgctcaggacgacgctggcgagacaccagccgatctggctgcagcttggggccacgaagatatcgccgaggtgctgcagaagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1749 - DNA, 3090 bp, Artificial Sequence
  Synthetic Polynucleotide encoding a CAR with optional accessory module(s)
atggactggatttggcgcatccttttccttgtcggcgctgctaccggcgcccattccttcgaaagaagcgatctgggaaagaagctgctggaagctgccagagccggacaggatgatgaagtgcgcatcctgatggcaaacggcgcagatgtgaacgcaaaggacgagtacggcctgacccccctgtacctggctacagcccacgggcacctggaaattgtggaagtgctgctgaagaacggcgctgacgtgaacgccgtggacgccatcggctttaccccactgcatctggccgctttcatcgggcatctcgaaatcgcagaggtgctgctgaaacacggggccgatgtgaatgcccaggacaagttcggcaagaccgccttcgacatcagcatcggcaacggcaacgaggacctggccgagatcctgcagaaactgaacacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1750 - DNA, 3546 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcaactggtggaaagcggcggaggcctggtgcaggctggcggatctctgagactgagctgtgccgccagcggcatcaccttcagcatcaacacaatgggctggtacagacaggcccctggcaagcagagggaactggtggccctgatctccagcatcggcgacacctactacgccgacagcgtgaagggccggttcaccatcagccgggacaacgccaagaacaccgtgtacctccagatgaacagcctgaagcccgaggacaccgccgtgtactactgcaagcggttcagaacagccgcccagggcaccgattattggggccagggaacacaagtgaccgtgtcctctctcgagggaggaggcggctccgggggaggcggaagtggaggcggaggatctgggtctggaggaagcggatctggaggctcagggtcagggggctcaggcagtggaggctctttcgaagtgcaactggtggaatctgggggcggactggtgcagccaggcggaagtctgaggctgtcttgtgccgcctccggcagcatcttcggcttcaacgacatggcctggtatcggcaggctcccggaaaacagcgcgagctggtggctctgattagcagagtgggcgtgaccagcagcgccgactctgtgaagggcagattcacaatctccagagtgaacgccaaggatacagtgtacctccagatgaactctctgaaacctgaggatacagcagtgtactattgctacatggaccagcggctggacggcagcacactggcctactggggacagggaactcaagtgacagtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1751 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccaggacgtgaacaccgccgtggcctggtatcagcagaagcctggcaaggcccccaagctgctgatctacagcgccagcttcctggaaagcggcgtgcccagcagattcagcggaagcagaagcggcaccgacttcaccctgaccatcagctccctccagcccgaggacttcgccacctactactgccagcagcactacaccacccctcccaccttcggccagaccaaggtggaaatcaagagaggcggaggcggaagtggaggcggaggatctggcggcggaggctctgaagtgcaactggtggaatctggcggcggactggtgcagcctggcggatctctgagactgagctgtgccgccagcggcttcaacatcaaggacacctacatccactgggtgcgccaggcccctggaaagggactggaatgggtggcccggatctaccccaccaacggctacaccagatacgccgacagcgtgaagggccggttcaccatcagcgccgacaccagcaagaataccgcctacctccagatgaacagcctgcgggccgaggataccgccgtgtactactgctcaagatggggaggcgacggcttctacgctatggacgtgtggggccagggcacccttgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1752 - DNA, 3075 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgacgtgcaactcgtggaatccggcggaggcctggtgcagcctggcggatctctgagactgagctgtgccgccagcggctctatcggcggactgaatgccatggcctggtacagacaggcccctggcaaagaacgggaactggtggccggcatctttggcgtgggcagcaccagatacgccgacagcgtgaagggccggttcaccatcagccgggacaacagcaagaacaccgtgtacctgcagatgaacagcctgcggcccgaggataccgccgtgtactactgcagaatgtccagcgtgaccagaggctccagcgactactggggccagggaacacttgtgaccgtgtccagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1753 - DNA, 2895 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgtggacaacaagttcaacaaagagcggtacagcgcctactacgagatttggcaactgcccaacctgaacgtgcggcagaaggccgccttcatcggatctctgcaggacgaccctagccagagcgccaatctgctggccgaggccaagaagctgaacgacgcccaggcccctaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1754 - DNA, 3561 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgacgtgcaactcgtggaatccggcggaggcctggtgcagcctggcggatctctgagactgagctgtgccgccagcggctctatcggcggactgaatgccatggcctggtacagacaggcccctggcaaagaacgggaactggtggccggcatctttggcgtgggcagcaccagatacgccgacagcgtgaagggccggttcaccatcagccgggacaacagcaagaacaccgtgtacctgcagatgaacagcctgcggcccgaggataccgccgtgtactactgcagaatgtccagcgtgaccagaggctccagcgactactggggccagggaacacttgtgaccgtgtccagtctcgagggaggaggcggctccgggggaggcggaagtggaggcggaggatctgggtctggaggaagcggatctggaggctcagggtcagggggctcaggcagtggaggctctttcgaagtgcaactggtggaatctggaggctctctggtgcagccagggggaagcctgagactgtcttgtgccgcttccggcttcaccttcgacgactacgccatgagctgggtgcgccaggtgccaggcaaaggcctggaatgggtgtccagcatcaactggagcggcacccacaccgattacgccgactccgtgaaaggcagattcacaatcagcagaaacaacgccaacaataccctgtacctgcagatgaactccctgaagtctgaggatacagcagtgtattattgcgccaagaactggcgggacgccggcaccacttggtttgagaaaagcggctctgccggacagggaacccaagtgacagtgtcctccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1755 - DNA, 3435 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtgctgacacagcctcctagcgtgtcagtggcccctggcaagaccgccagaatcccctgcgagggcaactacatcggcagcagcaacgtgcactggtatcagcagaagcccggccaggctcccgtgctcgtgatccacttcgacagcgacagacccagcggcatccccgacagattcagcggcagcaacagcggcaacatggctaccctgaccatcagcagagtggaagccggggacgaggccgactactactgtcaagtgtgggagaaccacggctgggtgttcggcggaggcaccaagctgacagtgctgtctggcggaggcggaagtggaggcggaggatctggcggcggaggctctgaggtgcaactggtggaaacaggcggcggactggtgcagcctggcgagtctctgagactgagctgtgccgccagcggcttcaccttcagcgactacgagatgaactgggtgcgccaggcccctggaaagggcctggaatgggtgtcctacatcagcagctccggcagcaccatctactacgccgacagcgtgaagggccggtttaccatctaccgggacaacgccaagaacagcctgtacctccagatgaactccctgcgggccgaggacaccgccctgtactattgtgccagagcctggggcgtgggaccccctgattattggggacagggcaccctcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1756 - DNA, 3459 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgataccgtgaccatcacctgtcaggccaacggctacctgaactggtatcagcagcggagaggcaaggcccccaagctgctgatctacgacggcagcaagctggaaagaggcgtgcccagcagattcagcggcagaagatggggccaggagtacaacctgaccatcaacaacctccagcccgaggatattgccacatacttttgccaggtgtacgagttcgtggtgcccggcacacggctggacctgaagagaacagtggctgctcctggcggaggcggaagtggaggcggaggatctggcggcggaggctctcaggtgcagctgctccagtctggcgctgccgtgacaaagcctggcgcttctgtgcgggtgtcctgtgaagccagcggctacaacatccgggactacttcatccactggtggcggcaggctccaggccagggactccagtgggtgggatggatcaaccccaagaccggccagcccaacaaccccagacagttccagggcagagtgtccctgaccagacacgccagctgggacttcgacaccttcagcttctacatggatctgaaggccctgcggagcgacgataccgccgtgtacttctgcgccagacagagaagcgactactgggatttcgacgtgtggggcagcggcacccaagtgacagtgtctagcgccagcaccaagggacccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1757 - DNA, 3477 bp, Artificial Sequence
  Synthetic Polynucleotide encoding a CAR with optional accessory module(s)
atggccttaccagtgaccgccttgctcctgccgctggccttgctgctccacgccgccaggccgcagtctgccctgacacagcctcctagcgcctctggctctcccggccagagcatcaccatcagctgtaccggcaccagcaacaacttcgtgtcctggtatcagcagcacgccggcaaggcccccaagctcgtgatctacgacgtgaacaagcggcccagcggcgtgcccgatagattcagcggcagcaagagcggcaacaccgccagcctgacagtgtctggcctccagaccgatgacgaggccgtgtactactgcggcagcctcgtgggcaactgggacgtgatctttggcggaggcaccaagctgaccgtgctgggcggaggcggaagtggaggcggaggatctggcggcggaggctctcagccccagctccaggaatctggccccacactggtggaagccagcgagacactgagcctgacctgtgccgtgtccggcgattctaccgccgcctgcaatagcttctggggctgggtgcgccagcctcctggaaagggactggaatgggtgggaagcctgagccactgcgccagctattggaaccggggctggacctaccacaaccccagcctgaagtccagactgaccctggccctggacacccccaagaacctggtgttcctgaagctgaacagcgtgacagccgccgacaccgccacctactactgtgccagatttggcggcgaggtgctgcggtacaccgactggcctaaacctgcctgggtggacctgtggggcagaggaacactcgtgaccgtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1758 - DNA, 3432 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgagacagccatcatcagctgccggacaagccagtacggcagcctggcctggtatcagcagaggccaggacaggcccccagactcgtgatctacagcggcagcacaagagccgccggaatccccgatagattcagcggctccagatggggacccgactacaacctgaccatcagcaacctggaaagcggcgacttcggcgtgtactactgccagcagtacgagttcttcggccagggcaccaaggtgcaggtggacatcaaaagaggcggaggcggaagtggaggcggaggatctggcggcggaggctctcaggtgcagctggtgcagtctggcggccagatgaagaaacccggcgagagcatgagaatcagctgtcgggcctccggctacgagttcatcgactgcaccctgaactggatcagactggcccctggcaagcggcctgagtggatgggatggctgaagcctagaggcggagccgtgaactacgccagacctctccagggcagagtgaccatgaccagggacgtgtacagcgataccgccttcctggaactgcggagcctgaccgtggatgataccgccgtgtacttctgcaccagaggcaagaactgcgattacaactgggacttcgagcactggggcagaggcacccctgtgatcgtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1759 - DNA, 3462 bp, Artificial Sequence
  Synthetic Polynucleotide encoding a CAR with optional accessory module(s)
atggccttaccagtgaccgccttgctcctgccgctggccttgctgctccacgccgccaggccggagctggtgctgacacagagccctggcaccctgtctctgtctgccggcgaaagagccaccctgagctgtagagccagccagagcgtgtcctctggcagcctggcttggtatcagcagaagccaggccaggcccccagactgctgatctacggcgcttctaccagagccaccggcatccccgatagattcagcggctctggctccggcaccgacttcaccctgacaatcggcagactggaacccgaggacctggccgtgtactactgccagcagtacggcaccagcccctacacattcggccagggcaccaagctggaaatcggcggaggcggaagtggaggcggaggatctggcggcggaggctctctggaacagagcggagccgaagtgaagaaacccggcagcagcgtgcaggtgtcctgcaaagcaagcggcggcaccttctctatgtacggcttcaactgggtgcgccaggctcctggacacggcctggaatggatgggcggcatcatccccatcttcggcacctccaactacgcccagaaattccggggcagagtgaccttcaccgccgaccaggccacaagcaccgcctacatggaactgaccaacctgcggagcgacgacaccgccgtgtattattgcgccagagacttcggccccgactgggaggatggcgacagctacgatggcagcggcagaggcttcttcgacttctggggccagggaacccttgtgaccgtgtcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1760 - DNA, 3450 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgacaatcacctgtcagagcagcctggacatcagccactacctgaactggtatcagcagaagcccggcaaggcccctaagctgctgatctacgacgccagcaatctggaaaccggcgtgcccagcagattttctggcagcggaagcggcacccacttcaccttcacaatatccagcctccagcctgaggacttcgccacctactactgccagcagtacgacaacctgcctctgacctttggcggaggcaccaagctggaaatcaagagaggcggaggcggaagtggaggcggaggatctggcggcggaggctctcaagttcaactggttcaatcaggcggaggcgtggtgcaacctggtggctctctgagagtgtcttgtgctgcctctggcgtgaccctgagcgactatggaatgcactgggtccgacaggcccctggcaaaggacttgagtgggtcgccttcatcagaaacgacggcagcgacaagtattacgccgacagcgtgaagggcagattcaccatcagccgggacaacagcgagaaaaccgtgtctctccagatgtctagcctgagagccgaggacaccgccgtgtactactgtgccaagaatggcgagagcggccctctggactactggtatctggatctgtggggcagaggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1761 - DNA, 3450 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgatgacccagagccaggacagcatggctaccagcgtgggcgagcgcgtgaccgtgaattgcaaggccagccagaacgtggacaccaacgtggcctggtatcagcagaagcccggccagtctcctgagcccctgctgttcagcgccagctacagatacaccggcgtgcccgacagattcagcggcagcggctctggcaccgacttcaccctgacaatcagcagcgtgcaggccgaggacgtggccgagtatttctgccagcagtacaacagctaccccctgaccttcggccagggcaccaagctggaaatcaagagaggcggaggcggaagtggaggcggaggatctggcggcggaggctctgaagtgcaggtggaagtgtctggcggcggactggtgcagcctggcggatctatgagactgagctgtgccgtgtccggcttcaccttcagcaactactggatgaactgggtgcgccagtcccccgagaagggcctggaatggatcgccgagatccggctgaagtccaacaacttcgcccggtactacgccgagagcgtgaagggcagattcaccatcagccgggacaacagcaagaacagcctgtacctccagatgatctccctgagagccgaggacaccgccatctactactgcaccagctacggcaactacgtgggccactacttcgaccactggggccagggaacactgctgaccgtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1762 - DNA, 3462 bp, Artificial Sequence
  Synthetic Polynucleotide encoding a CAR with optional accessory module(s)
atggccttaccagtgaccgccttgctcctgccgctggccttgctgctccacgccgccaggccgagctacgagctgacacagcctccatccgtgtctggcacacctggacagagagtggctatctcctgtagcggcagcagcagcaacatcggcaccagaatggtcacctggtatcagcacgtgccaggcacagcccctaagctgctgatcttcaacaacaaccagcggcctagcggcgtgcccgatagattttctgccagcaagagcggcacaagcgccagcctggctatcatcggactccagtctgacgacgaggccgactactactgtgccacctgggacgacaacgtgaagtcctacgtgttcggcaccggcaccaaagtgacagtgcttggaagtagaggcggaggcggaagtggaggcggaggatctggcggcggaggctctcttgaaatggcccaggttcagctccagcagtggggagctggactgctgaagcctagcgagacactgagcctgacctgtgctgtgtacggcggcagcttcagcggctactactggtcctggatcagacagcctcctggcaaaggactggaatggatcggcgagatcaaccacagcggctccaccaactacaaccccagcctgaagtccagagtgaccatcagcgtggacaccagcaagaaccagttctccctgaagctgagcagcgtgacagccgctgataccgccgtgtactattgcgctagagcccctcagtcttggtacgtgggagatgtgtggggccagggcacactggttacagtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1763 - DNA, 3453 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctcctagcctgtctgtggcccctggaaagacagccagcatcacatgcggcggcaacaacatcggcatgaagtccgtgcactggtatcagcagaggccaggacaggctcctgtgctggtcatctactacgacagcgacagaccctctggcatccccggcagattttccggcagcaactctggcaataccgccacactgaccatctccagagtggaagctggcgacgaggccgactactactgccaagtgtgggataccaccggcgatcaccctggctatgtgtttggcaccggcaccaaagtgacagtgcttggcggaggcggaagtggaggcggaggatctggcggcggaggctctcaagttcaactggttcagagcggagccgaagtgaagaaacctggcagcagcgtgaaggtgtcctgcaaagcaagcggcggcacctttagcagctacgccatctcttgggtccgacaggcacctggacaaggactggaatggatgggcggcatcatccccatcttcggcacagccaattacgcccagaaattccagggcagagtgaccatcaccgccgacgagtctacaagcaccgcctacatggaactgagcagcctgagaagcgaggacaccgccgtgtactattgtgccagaggcgtgtacggctacagcggctctgccccttatgatgagtggggccagggaaccctggtcaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1764 - DNA, 3471 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacccagagccctctgagcctgcctgtgacacctggcgagcctgccagcatctcctgtagaagcagccagagcctgctgcacagcaacggctacaactacctggactggtatctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagaccccccggacctttggacagggcaccaaggtggaaatcaagcggggcggaggcggaagtggaggcggaggatctggcggcggaggctctcaggtgcaactggtgcagtctggcggcggagtggtgcagcctggaagaagcctgagactgagctgtgccgccagcggcttcaccttcagcagctacggaatgcactgggtgcgccaggcccctggcaaaggactggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgcgccagagacttcgactacggcgacagctactactactatggcatggacgtgtggggccagggcacaaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1765 - DNA, 3453 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgggcagctacctggcctggtatcagcagaagcctggcgctccccggctgctgatctacgatgcctctcacagagccaccggcatccccgccagattttctggcagcggctccggcaccgacttcaccctgacaatcagctccctggaacccgaggacttcgccgtgtactactgccagcagcggagcaactggccccccatgtataccttcggccagggcaccaagctggaaatcaagagaggcggaggcggaagtggaggcggaggatctggcggcggaggctctgaagtgcagctggtgcagtctggcgctgaggtgtccgtgaaggtgtcctgcaaagccagcggcggcaagaagcccggcagcacctttagcagctacaccatcagctgggtgcgccaggcacctggacagggcctggaatggatgggcggcatcatccccatcttcggcaccgccaactacgcccagaaattccagggcagagtgaccatcaccgccgacaagagcaccagcaccgcctacatggaactgagcagcctgcggagcgaggacacagccgtgtattattgtgccggcgacaccgacagcagcggctactatggcgctgtggactattggggccagggaaccctcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1766 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtcaggccagccaggacatcaacaactacctgaactggtatcagcagaagcccggcaaggcccccaagctgctgatctacgacgccagcaatctgcagaccggcgtgcccagcagattttccggctctggcagcggcaccgacttcaccttcaccatcgaggacattgccacctactactgccagcagtacaccttcggccctggcaccaaggtggacatcaaaggcggaggcggaagtggaggcggaggatctggcggcggaggctctgaagtgcaactgctggaatctggcggcggactggtgcagcctggcggatctctgagactgagctgtgccgccagcggcttcacctttagctggtacagcatgacctgggtgcgccaggcccctggcaaaggactggaatgggtgtccagcatcgtgccctggggcgatttcacccagtacgccgatagcgtgaagggccggttcaccatcagccgggacaacagcaagaacaccctgtacctgcagatgaacagcctgcgggccgaggacaccgccgtgtactattgtgccaagggacctggctggggcagcttcgatctgtggggcagaggaacccttgtgaccgtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1767 - DNA, 3069 bp, Artificial Sequence
  Synthetic Polynucleotide encoding a CAR with optional accessory module(s)
atggactggatttggcgcatccttttccttgtcggcgctgctaccggcgcccattccgaggttcagttggtcgaatcaggcgggggcctcgtccaacccggcggaagcctgcggctgtcttgcgcagcaagtggtagtgtgttcaagatcaacgttatggcctggtatcgccaggctccgggaaaagggagagagctggttgcggggatcattagcggtggctccaccagctacgctgacagtgtgaagggaaggttcactatatcacgcgacaacgcaaagaatacattgtacctccagatgaatagcttgcggcccgaagacacggcagtctactattgtgcctttatcacaacagagagcgactatgacctgggccgccggtattgggggcagggaacccttgtgaccgtttcatccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1768 - DNA, 3432 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtaccgccagcctgagcgtgtccagcacctacctgcactggtatcagcagaagcccggcagcagccccaagctgtggatctacagcaccagcaacctggcctccggcgtgcccagcagattttctggcagcggctctggcaccagctacaccctgaccatcagctccctccagcccgaggacttcgccacctactactgccaccagtaccacagaagccccctgacctttggcggaggcaccaaggtggaaatcaagagaggcggaggcggaagtggaggcggaggatctggcggcggaggctctgaagtgcaactggtggaatctggcggcggactggtgcagcctggcggatctctgagactgagctgtgccgccagcggcttcagcctgaccaaatacggcgtgcactgggtgcgccaggcccctggaaaaggactggaatgggtgggagtgaagtgggctggcggctccaccgactacaacagcgccctgatgagccggttcaccatcagcaaggacaacgccaagaacagcctgtacctccagatgaactccctgcgggccgaggacaccgccgtgtactactgtgccagagatcaccgggacgctatggactactggggccagggaacactcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1769 - DNA, 3444 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgggaacagccgtggcctggtatcagcagaagcctggcaaggcccccaagctgctgatctacagcgccagctacagatccaccggcgtgcccagcagattttccggctctggcagcggcaccgacttcaccctgaccatctctagcctccagcccgaggacttcgccacctactactgccagcaccactactccgccccctggacatttggcggaggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagaaacggcatgagctgggtgcgccaggcccctggaaaaggactggaatgggtggcaaccgtgtccagcggcggcagctacatctactacgccgacagcgtgaagggccggttcaccatctccagagacaacgccaagaacagcctgtacctccagatgaactccctgcgggccgaggacaccgccgtgtactattgtgccagacagggcaccaccgccctggctaccagattcttcgatgtgtggggccagggcaccctcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1770 - DNA, 3462 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccagcagcctgaccatgagcgtgggccagaaagtgaccatgtcctgcaagagcagccacagcctgctgaacagccggaaccagaagaactacctggcctggttccagcagaagcccggccagtcccccaagctgctggtgtacttcgcaagcacccgcgagagcggcgtgcccgacagattcatcggcagcggctccggcaccgacttcaccctgaccatcagcaacgtgcaggccgaggacctggccgactacttctgccagcagcactacaccaccctgcccaccttcggcggaggcaccaagctggaaatcaagggcggaggcggaagtggaggcggaggatctggcggcggaggctctcagatccagctggtgcagagcggccctgacctgaagaaacccggcgagacagtgaagatcagttgcaaggcctccggctacaccttcaccaacacaggcatgaactgggtcaagcaggcccctggcaagggcctgaagtggatgggctggatcaacacctacaccggcgagcccacctacgccgacgacttcaagggccggttcaccttcagcctggaaaccagcgccagcaccgcctacctgcagatcaacaacctgaagaacgaggacaccgccacctatttctgcaccagatggggctacggcagcagcctgtactacgccatggactactggggccagggcaccagcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1771 - DNA, 3432 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagcccccctagcctgtctgcctctgtgggcggcaaagtgaccatcacatgcaaggccagccaggacatcgaccgctacatggcctggtatcaggacaagcccggcaagggacccaagctgctgatccacgataccagcaccctccagcccggcatccccagcagattttctggcagcggctccggcagagactacagcttcagcatcagcaacctggaacccgaggacattgccacctactactgcctccagtacgacaacctgtggaccttcggcggaggcaccaagctggaaatcaagagaggcggaggcggaagtggaggcggaggatctggcggcggaggctctcaggtgcaactggtgcagagcggagccgagcttgtgaagcctggcgcttccgtgaagatgagctgcaaagccagcggctacatcttcaccaactacaacatccactgggtcaagaagtccccaggccagggcctggaatggatcggagccatctaccccggaaacggcgacgccccttacagccagaagttccaggacagagccaccctgaccgccgacaccagcagcagcaccacctacatggaactgagcagcctgaccagcgaggacagcgccgtgtactattgcgtgcgggccaactgggatgtggccttcgcctattggggccagggcacactggtgtccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1772 - DNA, 3435 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccctgccagcctgtctgcctctgtgggcgagacagtgaccatcacctgtcgggtgtccggcaacatccacaactacctggcctggtatcagcagaagcagggcaagagcccccaactgctggtgtacaacgccaagaccctggccgatggcgtgcccagcagattttctggctctggcagcggcacccagtacagcctgaagatcaacagcctccagcccgaggacttcggcagctactactgccagcacttctggtccaacccctacaccttcggcggaggcaccaagctggaaatcaagggcggaggcggaagtggaggcggaggatctggcggcggaggctctcaggtgcaactccagcagtctggcgcttccgtgaaggtgtcctgcaaggccagcgaactcgtgcggcctggcacaggctacgccttcaccaattacctgatcgagtgggtcaagcagaggcccggacagggcctggaatggatcggagtgattaacccaggcagcggcggcaccaactacaacgagaagttcaagggcaaggccaccctgaccgccgacaagagcagcagcacagcctacatgcaactgagcagcctgaccagcgacgacagcgccgtgtacttctgcgcccggtacagaagctacgactggtacttcgacgtgtggggagccggcaccaccgtgacagtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1773 - DNA, 3450 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcagcctgtctgccagcgtgggcgacagagtgaccatcacctgtcggagcagccagcggatcgtgcacagcaacggcaacacctacctggaatggtatcagcagacccccggcaaggcccccaagctgctgatctacaaggtgtccaacagattcagcggcgtgcccagcaggtttagcggctctggcagcggcaccgactacacccctaccatctctagcctccagcccgaggacattgccacctactactgttttcaaggcagccacgtgccccccaccttcggccagggaacaaagctccagatcaccggcggaggcggaagtggaggcggaggatctggcggcggaggctctgaggtgcaactggtggaatctggcggcggagtggtgcagcctggcagaagcctgagactgagctgtagcagcagcggccctaccttcagcgactactacatgtactgggtgcgccaggcccctggcaagggactggaatgggtggcctacatgagcaacgtgggagccatcaccgattaccccgacaccgtgaagggcagacccaccatcagccgggacaacagcaagaataccctgttcctgatggacagcctgcggcccgaggataccggcgtgtacttttgcgccagaggcaccagggacggcagttggttcgcctattggggccagggcacacccgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1774 - DNA, 3432 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagcttcagcagcctgagcgccagcgtgggcgacagagtgaccatcacctgtagagccagccaggacatcagcaactacctgaactggtatcagcagaagcccggcaaggcccccaagctgctgatctactacaccagcagactgcacagcggcgtgcccagcagattttctggcagcggctccggcaccgactacaccctgacaatcagctccctgcagcccgaggacttcgctacctacttctgtcagcaaggcaacaccctgccctggacctttggcggaggcaccaagctggaaatcaagagaggcggaggcggaagtggaggcggaggatctggcggcggaggctctgaagtgcaactggtgcagtccggcggagggctggtgcagagcggaggatctctgagactgagctgcagagccagcggctacaccttcacccggtactggatgctgtgggtgcgccagaggccaggcaagggactggaatgggtggccgagatcaacccccggaacgaccggaccaactacaacgagaagttcaagacccggttcaccatcagcgtggacagaagcaagaacaccctgtacctgcagatggacagcctgcgggccgaggataccgccgtgtacttttgtgctctgggaggcggctacgctatggactactggggccagggaacccttgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1775 - DNA, 3393 bp, Artificial Sequence
  Synthetic Polynucleotide encoding a CAR with optional accessory module(s)
atggaaatgctccagggcctgctgctgctcctgctgctttctatgggcggagcttgggccagcagagagcctcttagaccttggtgtcaccccatcaacgccatcctggccgtggaaaaagagggctgccctgtctgcatcaccgtgaacaccacaatctgcgccggctactgccccaccatgatgagagtgctgcaagccgttctgcctcctctgcctcaggtcgtgtgcacctatcgggacgtccgcttcgagagcatcagactgcctggatgtcctagaggcgtggaccccgtggtgtcttttcctgtggctctgtcctgtagatgcggcccctgtagaagaagcaccagcgattgcggcggacccaaggatcaccctctgacatgcgatcacccacagctgagcggcctgttgtttcttggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1776 - DNA, 3435 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagtctccggcgtcactgtccgcctccgtgggggagactgtgactattatttgtagggcatcagttaacatctactcttatttggcctggtaccagcagaagcaaggcaagagtcctcagctgctggtgtataatgcgaagatcctggcagagggcgtgccgagccggttctccggcagcggctcaggtacccaattttccctcaagatcaattcactgcagccagaggactttggcagttactattgtcaacaccactacggcacattcactttcgggtccggtacaaaattggagattaagcgaggcggaggcggaagtggaggcggaggatctggcggcggaggctctcaggtacagttgaaagaaagcgggcctggactggtagcgccttcccaatctctctccatcacgtgcaccatctctggcttctccctgacttcctatggagttcactgggtgaggcagccccccggcaagggactggaatggctggtcgtcatctggtccgacgggtccacaacctacaactccgctctgaaaagtcggctctctatttctaaagataatagcaagagccaggtgtttctgaaaatgaactctctgcagaccgatgatacggccatttactactgcgcttcacactatggctcaaccttggcattcgcttcctggggccacggaacactggtgaccgtttccgcagccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1777 - DNA, 3459 bp, Artificial Sequence
  Synthetic Polynucleotide encoding a CAR with optional accessory module(s)
atggccttaccagtgaccgccttgctcctgccgctggccttgctgctccacgccgccaggccggacattgtgatgacccagtctcacaaattcatgtccacatcagtaggagacagggtcagcgtcacctgcaaggccagtcagaatgtgggtaataatgtagcctggtatcaacagaaaccagggcaatctcctaaagtactgatttactcggcatcctaccggtacagtggagtccctgatcgcttcacaggcagtggatctgggacagatttcactctcaccatcagtaatgtgcagtctgaagacttggcagagtatttctgtcagcaatataacacctatccattcacgttcggctcggggacaaagttggaaataaaaggcggaggcggaagtggaggcggaggatctggcggcggaggctctgaggtacagctggaggaaagcggtggaggactggtgcaacctggagggtctatgaagctctcttgcgtagcttctgggttcacgttctccaattactggatgaactgggtgcggcagtcccccgagaaaggcctggaatgggtagcagaaattcggttcaagtcccataactatgctacacactttgccgagtctgtcaaaggccggttcactattagtcgagacgacagcaagtcttcagtctacctgcagatgaataacttgcgggcagaggacacaggtatctactactgcaccaggagaatcggcaactccgactatgactggtggtactttgacgtctggggagcaggcaccagcgtgacggtgagttcagcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1778 - DNA, 3447 bp, Artificial Sequence; identical to SEQ ID NO: 1663
  Synthetic Polynucleotide encoding a CAR with optional accessory module(s)

SEQ ID NO: 1779 - DNA, 3465 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtgctgacacagcctccatccgtgtctggcgctccaggccagagagtgaccatctcctgtaccggcagcagcagcaacatcggagccggctatgacgtgcactggtatcagcaactgcccggcaccgcccccaagctgctgatctacggcaacagcaacagacccagcggcgtgcccgatagattcagcggcagcaagagcggcacaagcgccagcctggctatcactggactccaggccgaggacgaggccgactactactgccagagctacgacaacagcctgtcctcctgggtgttcggcggaggcaccaagctgacagtgctgggccagcctaagggcggaggcggaagtggaggcggaggatctggcggcggaggctctgaagtgcaactccagcagagcggagccgaagtgaagaaacccggcagctccgtgaaggtgtcctgcaaggcttccggcggcaccttcagcagctacgccatttcttgggtgcgccaggcccctggacagggcctggaatggatgggcagaatcatccccatcctgggaatcgccaactacgcccagaaattccagggccgcgtgaccatcaccgccgacaagagcacaagcaccgcctacatggaactgagcagcctgcggagcgaggacaccgccgtgtactactgcgccagagatgtgggcagcggctcctacagcctggactattggggccagggcaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1780 - DNA, 3456 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtcgtgacacagcctccatctgtgtctgccgcccctggccggaaagtgaccatctcttgtagcggcagcagcagcaacatcggcagcaactacgtgtcctggtatcagcaggtgcccggcaccgcccctaagctgctgatctacgaggacgacaagcggcccagcggcatccccgatagattcagcggctctaagagcggcaccagcgccacactgggcatcaccggactccagacaggcgacgaggccgactacttctgcgccacctgggacagaaccgtgaacgtggtgcgctttggcggcggaaccagactgacagtgcacagccagcctaagggcggaggcggaagtggaggcggaggatctggcggcggaggctctcaactccaactccaggaaagcggccctggcctcgtgaagcctagcgagacactgagcctgacctgcaccgtgtctggcggcagcatctccagcagctcctactactggggctggatcagacagccccctggcaagggcctggaatggatcggctccatctactacagcggaagcacctactacaaccccagcctgaagtcccgcgtgaccatcagcgtggacaccagcaagaaccagttctccctgaagctgagcagcgtgacagccgccgataccgccgtgtactactgtgccagacatgtgggccacgagctggattactggggccagggcacactcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1781 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgccagctctctgcagtctggcgtgccatctggctttagcggcagcggctctggcaccgacttcaccctgaccatcagctccctgcagcccgaggacttcgccacctactactgccagcagagctacagcacccccctgacctttggcggaggcaccaaggtggaaatcaagagaggcggcggaggctcaggcggaggcggatctggcgggggaggatctcaggtgcaactgcaggaatctggccctggcctcgtgaagcccagcgagacactgagcctgacctgtaccgtgtctggcggctctgtgtccagcggcagctactactggtcctggatcagacagccccctggcaagggcctggaatggatcggctacatctactacagcggctccaccaactacaaccccagcctgaagtcccgcgtgaccatctccgtggacaccagcaagaaccagttctccctgaagctgagcagcgtgacagccgccgataccgccgtgtactactgtgccagagagggcaagaacggggccttcgacatctggggccagggcacaatggtcaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1782 - DNA, 3096 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgatgttcagttggtggagtctggtggcggtttggtgcagccaggtggctccctgcgactcagttgtgcagcctccgggttcattctggattactacgctattggttggtttcgacaggcccccggaaaggagagagagggcgtgctctgcattgatgccagcgacgacattacctactacgccgattctgtgaagggccgcttcaccatcagtagagacaatagcaagaatacagtctacctgcagatgaactccctgcgcccagaagacactgccgtctactactgtgctacccctatcgggctttcttcctcttgccttctcgaatatgactacgattactgggggcaggggacgctggtcaccgtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1783 - DNA, 3585 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgatgttcagttggtggagtctggtggcggtttggtgcagccaggtggctccctgcgactcagttgtgcagcctccgggttcattctggattactacgctattggttggtttcgacaggcccccggaaaggagagagagggcgtgctctgcattgatgccagcgacgacattacctactacgccgattctgtgaagggccgcttcaccatcagtagagacaatagcaagaatacagtctacctgcagatgaactccctgcgcccagaagacactgccgtctactactgtgctacccctatcgggctttcttcctcttgccttctcgaatatgactacgattactgggggcaggggacgctggtcaccgtgtctagcctcgagggaggtagcggctccgggggaggcggaagtggaggcggaggatctgggtctggaggaagcggatctggaggctcagggtcagggggctcaggcagtggaggctctttcgaagtgcaactggtggagtccggcggtggactggtacagcctgggggttcactgcgcctgtcctgcgccgccagcggaagaacctattacctcaatgctatgggttggttccgccaggccccaggaaaggagcgcgagttcgtggcggctattgactggtccgaggggaacaaggactatgctgattccgtgaagggcaggtttaccatcagccgggataattcaaaaaatactgtttatttgcagatgaactctcttagaccagaagacactgctgtctattactgcgccgctgacacccctccttggggaccactgatttatatcgaaagctatgattcctgggggcagggcacactcgtcaccgtgagtagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1784 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccggaccagatcgtgctgacccagtcccccgctattatgtccgcatcaccgggcgaaaaagtgacgatctcctgtagcgcttcatctagcgtctcctacatgtattggtatcaacagaaacctgggtctagcccaaagccgtggatctacagaaccagtaaccttgccagtggggtgccagcccgcttcagcggtagtggcagtggaacttcctatagcctcacaataagcaacatggaggctgaagatgccgctgcctattactgccagcagtaccacagttacccaaccacgttcggcgggggaactaagctcgaagtaaaaggcggaggcggaagtggaggcggaggatctggcggcggaggctctgaggtgcagctggtggaatctgggggcggcctggtccaacctaagggatcactcaagctctcttgtgcggccagcggattctctttcaatacctatgctatgaattgggtgagacaggcgcccggaaagggcctcgaatggatagcccatatccggtcaaaatcaaacaatttcgcaacctactatgcggactccgtgaaggaccgattttccatctcccgagatgcctccgagaatattctgttcctgcagatgaataacctcaagacagaggacaccgccatgtactactgtgtgcgccagggcggtgactttcccatggattactgggggcaggggaccagcgtgaccgtgagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1785 - DNA, 3435 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagcagcagcagcttcagcgtgagcctgggcgacagagtgaccatcacctgcatggccagcgaggacatctacatcagactggcctggtaccagcagaagcccggcaacgcccccagactgctgatcagcgccgccaccagcctggagaccggcgtgcccagcagattcagcggcagcggcagcggcaaggactacaccctgagcatcaccagcctgcagaccgaggacgtgggcacctactactgccagcagtactggagcagcccctggaccttcggcggcggcaccaagctggagatcaacggcggaggcggaagtggaggcggaggatctggcggcggaggctctgacgtgcagctgcaggagagcggccccggcctggtgaagcccagccagagcctgagcctgacctgcaccgtgaccggctacagcatcaccagcgactacacctggaactggatcagacagttccccggcaacaagctggagtggatgggctacatcacctacagcggcagcaccagctacaaccccagcctgaagagcagaaacagcatcaccagagacaccagcaagaaccagttcttcctgcagctgaacagcgtgaccaccgaggacaccgccacctactactgcgccagactgggcagaagatacacaatggactactggggccagggcaccagcgtgaccgtgagcagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1786 - DNA, 3432 bp, Artificial Sequence
  Synthetic Polynucleotide encoding a CAR with optional accessory module(s)
atggccctgcctgtgacagctctgctgctgcctctggcactgctgctgcacgccgccagacctgatgtgcagctccaggaaagcggccctggcctcgtgaagcctagccagagcctgagcctgacatgcaccgtgaccggctacagcatcaccagcgactacacctggaactggatcagacagttccccggcaacaagctggaatggatgggctacatcacctacagcggcagcaccagctacaaccccagcctgaagtcccggaactccatcaccagagacaccagcaagaaccagttcttcttgcagctgaacagcgtgaccaccgaggacaccgccacctactactgcgccagactgggcagacggtacaccatggactattggggccagggcacctccgtgaccgtgtctagcggaggcggaggaagtggcggcggaggatctgggggaggcggaagcgatatccagatgacccagtccagcagcagcttcagcgtgtccctgggcgacagagtgaccatcacctgtatggcctccgaggacatctacatccggctggcctggtatcagcagaagcccggcaacgcccccagactgctgattagcgccgccacctctctggaaaccggcgtgccaagcagattcagcggctctggcagcggcaaggactacaccctgagcatcacctccttgcagaccgaggacgtgggcacctactattgccagcagtattggagcagcccctggacctttggcggaggcacaaagctggaaatcaacacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1787 - DNA, 3435 bp, Artificial Sequence
  Synthetic Polynucleotide encoding a CAR with optional accessory module(s)
atggccctgcctgtgacagctctgctgctgcctctggcactgctgctgcacgccgccagacctgacatccagatgacccagagcagcagcagcttcagcgtgtccctgggcgacagagtgaccatcacatgcaaggccagcgaggacatctacatccggctggcctggtatcagcagaagcccggcaacgcccccagactgctgattagcgccgccacctctctggaaaccggcatccccagcagattctccggctctggcagcggcgaggactacaccctgacaatcaccagcctccagaccgaggacgtggcaacctactactgccagcagtattggaccaccccctggacctttggcggaggcaccaagctggaaatcaagagaggcggaggcggaagtggaggcggaggatctggcggcggaggctctgatgtgcagctccaggaatctggccccggactcgtgaagcctagccagagcctgagcctgacatgcaccgtgaccggctacagcatcaccatcgactacacctggaactggatcagacagttccccggcaacaaactggaatggatgggctacatcacctacagcggcagcaccgactacaaccccagcctgaagtccagaagctccatcaccagagacacctctatgaaccagttcttcttgcagctgaacagcgtgaccaccgaggacaccgccacctactattgcgccagactgggcagaagatacgccctggactattggggccagggcaccagcgtgacagtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1788 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccggacatcgtaatgacccaggctgccccatccataccagtcactcccggtgaatccgtgtctatatcttgtaggtccgataagagtctgcttcacagcaacggcaatacttatcttttctggtttttgcagcgaccgggacaaagcccacaactgctgatctatagaatgtcaaatcttgcatcaggggtcccagatcgctttagtggatctgggtcaggcacagctttcaccctgagaatctccggagtggaagcagaagacgtaggcgtgtattactgtatgcagcaccttgagtatccttatacctttggaggcggaactaagctcgaaattaaaggcggaggcggaagtggaggcggaggatctggcggcggaggctctcaggttcaactgcagcagtctggacctgaactggtgaagcctggggcctcagtgaagatgtcctgcaaggcttctggctacgcattcagtagttcctggttgaactgggtgaggcagaggcctggaaagggtcttgagtggattggacggatttatcctggagatggagaaaatcactataatgggaaattcaagggcaaggccacactgactgcagacaaatcctccagcacaggctacatgcaactcagcagcctgacgtctgaggactctgcggtctacttctgtgcaagttattatgaagggggttattggggccaagggactctaatcactgtctctgcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1789 - DNA, 3435 bp, Artificial Sequence
  Synthetic Polynucleotide encoding a CAR with optional accessory module(s)
atggccttaccagtgaccgccttgctcctgccgctggccttgctgctccacgccgccaggccggacatcgtactgacacagagccccgcttctctggcagtgtcactgggccagtccgttacaatatcctgtcgggcgagtgaatccgtggaatactatggaacaagtctcatgcagtggtatcagcagaaacctggacagccccccaagctgctcatctacggtgcgtcaaatgtcgagagtggggttccggcccgattcagtggttccgggagtggcacagactttagcctcaacatccatcctgttgaggaagacgatattgccatgtatttttgccaacagtcccgcaaagtcccctggacctttggtggaggaactaagctggagatcaagggcggaggcggaagtggaggcggaggatctggcggcggaggctctgaggtcaagctggtagagagtggaggtgggctggttaaaccaggggggagcagaaaactgagttgtgccgcaagtggcttcaccttttctagctataccatgagctgggtaagacaaactccagcaaagcgccttgagtgggtcgcaacaattagcagcggatcttctactatttattacgctgacactgttaagggccggtttaccatatcaagagacaacgccaagaatacccttttccttcaaatgacttcactgcggtccgaggatacggcaatgtactattgtgcacgacggtggtttctcgactgctggggccaggggactacccttaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1790 - DNA, 3444 bp, Artificial Sequence
  Synthetic Polynucleotide encoding a CAR with optional accessory module(s)
atggccttaccagtgaccgccttgctcctgccgctggccttgctgctccacgccgccaggccggaccaggtgcagctgcagcagtcgggcccaggactggtgaagccttcggagaccctgtccctcacctgcactgtctctggtgactccatcagtagttactactggagctggatcaggcagcccccagggaagggactggagtggattgggtatatctattacagtgggagcaccaactacaacccctccctcaagagtcgagtcaccatatcagtagacacgtccaagagccagttctccctgaagctgagctctgtgaccgccgcagacacggccgtgtattactgtgcgcgcggcaggtacttcgatgtctggggacgaggcactatggtgactagcagcggcggaggcggaagtggaggcggaggatctggcggcggaggctcttcctcctacgtgctgactcagcctccctccgtgtctgggtctcctggacagtcgatcaccatctcctgcactggaaccagcagtgacgttggtggttataactatgtctcctggtaccaacaacacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgcagctcatatacaaccaggagcacccgagttttcggcggagggaccaagctgaccgtcctaggtgccgccgcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1791 - DNA, 3447 bp, Artificial Sequence
  Synthetic Polynucleotide encoding a CAR with optional accessory module(s)
atggccttaccagtgaccgccttgctcctgccgctggccttgctgctccacgccgccaggccggacatcgtaatgacacagtctcccctgtccctccctgtcacaccaggtgaacctgccagtatttcttgtagatccagtaagtcacttctgcactccaatgggaacacctacctgtattggttccagcaaaagcctggtcaggcacctcgcttgcttatttataggatgtccaatcttgcatccggcgtgccagaccgattctcaggctccggctctggtactgcatttaccctgaaaatctcccgcgtggaagcagaagatgtgggcgtgtactactgtatgcagcacatcgagtaccccttcacgtttggtcaaggcacaaagctggaaatcaaaggcggaggcggaagtggaggcggaggatctggcggcggaggctctcaggtccagctcgtccagtctggacccgaagtcaagaagccaggcgcctctgtgaaggtttcttgtaaggccagcggatatacattcactaattcatggatgaactgggtgaggcagcgccctggcaaggggcttgagtggatcgggcggatttacccaggggatggcgagacaatttacaacgggaaatttcgggtgagagtgacgatcaccgcagacgaatctacaagcacggcctacatggagttgtcctctctcaggagtgaggacaccgccgtctactattgtgctagaggttatgacgactattcattcgcatactggggccagggcaccaccgtcacagtatcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1792 - DNA, 3447 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgatgacccagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccaccagtacggcagcagcccccagacctttggacagggcaccaaggtggaaatcaagcggggcggaggcggaagtggaggcggaggatctggcggcggaggctctgaagtgcagctggtgcagtctggggccgaagtgaagaaacccggcagctccgtgaaggtgtcctgcaaggcttccggcggcaccttcagcagctacgccatttcttgggtgcgccaggcccctggacagggactggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccgtgcactacggcgactacgtgttcagcagcatggacgtgtggggccagggcacaaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1793 - DNA, 3456 bp, Artificial Sequence
  Synthetic Polynucleotide encoding a CAR with optional accessory module(s)
atggccttaccagtgaccgccttgctcctgccgctggccttgctgctccacgccgccaggccggacgagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagccccagaacattcggccagggcaccaaggtggaaatcaagagaggcggaggcggaagtggaggcggaggatctggcggcggaggctctgaagtgcaactggtgcagagcggagccgaagtgaagaaacccggcagctccgtgaaggtgtcctgcaaggcttccggcggcaccttcagcagctacgccatttcttgggtgcgccaggcccctggacagggcctggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccagaggccccgagtattgcatcaacggcgtgtgcagcctggacgtgtggggccagggaacaaccgtgaccgtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1794 - DNA, 3462 bp, Artificial Sequence
  Synthetic Polynucleotide encoding a CAR with optional accessory module(s)
atggccttaccagtgaccgccttgctcctgccgctggccttgctgctccacgccgccaggccggacatcgagctgacccagagccctagcagcctggctgtgtctgccggcgagaaagtgaccatgagctgcaagagcagccagagcctgctgaacagccggacccggaagaatcaactggcctggtatcagcagaagcccggccagtctcccgagctgctgatctactgggccagcaccagacagagcggcgtgcccgatagattcacaggcagcggctccggcaccgacttcaccctgacaatcagcagcgtgcaggccgaggacctggccgtgtactactgccagcagagctacaacctgctgaccttcggccctggcaccaagctggaagtgaagagaggcggaggcggaagtggaggcggaggatctggcggcggaggctctgtgaagctgcaggaatctggcggcggattcgtgaagcctggcggctctctgaaggtgtcctgtgccgccagcggcttcaccttcagcagctacgccatgtcctgggtgcgcctgagccccgagatgagactggaatgggtggcaaccatcagctccgcaggcggctacatcttctacagcgactccgtgcagggccggttcaccatctccagagacaacgccaagaacaccctgcatctgcagatgggcagcctgagaagcggcgacaccgccatgtactattgcgccagacagggcttcggcaactacggcgactactacgctatggactactggggccagggaaccaccgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1795 - DNA, 3459 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtcggagcagccagaacatcgtgcacagcaacggcaacacctacctggactggtatcagcagacccccggcaaggcccccaagctgctgatctacaaggtgtccaacagattcagcggcgtgcccagcaggtttagcggctctggcagcggcaccgacttcaccttcaccatcagctccctccagcccgaggacattgccacctactactgcttccagtacagccacgtgccctggaccttcggccagggcacaaagctccagatcggcggaggcggaagtggaggcggaggatctggcggcggaggctctcaggtgcagctccagcagtctggggccgaagtgaagaaacccggcagcagcgtgaaggtgtcctgcaaggccagcggctacacctttaccaactactacatctactgggtgcgccaggccccaggccagggactggaatggatcggcggcatcaatcctaccagcggcggcagcaacttcaacgagaagttcaagacccgcgtgacaatcaccgccgacgagagcagcaccaccgcctacatggaactgagcagcctgcggagcgaggataccgccttctacttctgcacccggcagggcctgtggttcgactctgatggcagaggcttcgacttctggggccagggaaccaccgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1796 - DNA, 3147 bp, Artificial Sequence
  Synthetic Polynucleotide encoding a CAR with optional accessory module(s)
atggccttaccagtgaccgccttgctcctgccgctggccttgctgctccacgccgccaggccgctgttcaaccaggaagtgcagatccccctgaccgagagctactgcggcccctgccccaagaactggatctgctacaagaacaactgctaccagttcttcgacgagagcaagaattggtacgagagccaggcttcctgcatgagccagaacgccagcctgctgaaggtgtacagcaaagaggaccaggatctgctgaagctggtcaagagctaccactggatgggcctggtgcacatccccaccaacggctcttggcagtgggaggacggcagcatcctgagccccaacctgctgaccatcatcgagatgcagaagggcgactgcgccctgtacgccagcagcttcaagggctacatcgagaactgctccacccccaacacctacatctgtatgcagcggaccgtgggcggaggcggaagtggaggcggaggagacacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1797 - DNA, 3429 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctggacctttggacagggcaccaaggtggaaatcaagagaggcggaggcggaagtggaggcggaggatctggcggcggaggctctcaagtgcatctccaggaaagcggacccggcctcgtgaagcctagcgagacactgagcctgacctgcaccgtgtccgacgacagcatcagcagctactactggtcctggatcagacagccccctggcaagggcctggaatggatcggccacatcagctacagcggcagcgccaactacaaccccagcctgaagtccagagtgaccatctccgtggacaccagcaagaaccagttctccctgaagctgagcagcgtgacagccgccgacaccgccgtgtattattgcgccaactgggacgacgccttcaacatctggggccagggcacaatggtcaccgtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1798 - DNA, 3435 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagacccctctgaccctgagcgtgaccattggacagcccgccagcatctcctgcaagagcagccagagcctgctggacagcgacggcaagacctatctccactggctgttgcaacggccaggtcagagccccaagagactgatcttcctggtgtccaagctggactccggcgtgcccgatagattcacaggcagcggctccggcaccgacttcaccctgaagatcagccgggtggaagccgaggacctgggcgtgtactactgttggcagggcacccacttcccccagacctttggcggcggaacaaagctggaaatcaagggcggaggcggaagtggaggcggaggatctggcggcggaggctctgtgcaactccaagagtccggccctgacctcgtgaagcctagccagtctctgagcctgacctgcaccgtgaccggctacagcatcaccagcggctactcttggcactggatcagacagttccccggcaacaagctggaatggatgggctacatccactacagcggcgacaccgactacaaccccagcctgaagtcccggttctccatcaccagagacaccagcaagaaccagttcttcttgcaactgaactccgtgaccaccgaggacaccgccacctactactgtgccacccctggcggctttgtgtactggggccagggaacactcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1799 - DNA, 3447 bp, Artificial Sequence
  Synthetic Polynucleotide encoding a CAR with optional accessory module(s)
atggccttaccagtgaccgccttgctcctgccgctggccttgctgctccacgccgccaggccggaccagagcgagctgacccagcctagaagcgtgtccggcagccctggacagagcgtgaccatcagctgtaccggcaccgagagagatgtgggcggctacaactacgtgtcctggtatcagcagcaccccggcaaggcccccaagctgatcatccacgacgtgatcgagcggagcagcggcgtgcccgatagattcagcggcagcaagagcggcaacaccgccagcctgacaatcagcggactgcaggccgaggacgaggccgactactactgctggtctttcgctggcggctactacgtgttcggcaccggcacagatgtgaccgtgctgggcggaggcggaagtggaggcggaggatctggcggcggaggctctttcgaagtgcagctgctggaatctggcggcggactggtgcagcctggcggatctctgagactgagctgtgccgcctccggcttcaccttcagcacctaccagatgagctgggtgcgccaggcccctggcaaaggactggaatgggtgtccgggatcgtgtccagcggcggctctacagcctacgccgatagcgtgaagggccggttcaccatcagccgggacaacagcaagaacaccctgtacctgcagatgaacagcctgagagccgaggacaccgccgtgtactattgtgccggcgagctgctgccctactacggcatggatgtgtggggccagggcaccaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1800 - DNA, 3444 bp, Artificial Sequence
  Synthetic Polynucleotide encoding a CAR with optional accessory module(s)
atggccttaccagtgaccgccttgctcctgccgctggccttgctgctccacgccgccaggccggaccagagcgagctgacccagcctagaagcgtgtccggcagccctggacagagcgtgaccatcagctgtaccggcaccgagagagatgtgggcggctacaactacgtgtcctggtatcagcagcaccccggcaaggcccccaagctgatcatccacgacgtgatcgagcggagcagcggcgtgcccgatagattcagcggcagcaagagcggcaacaccgccagcctgacaatcagcggactgcaggccgaggacgaggccgactactactgctggtctttcgctggcggctactacgtgttcggcaccggcacagatgtgaccgtgctgggcggaggcggaagtggaggcggaggatctggcggcggaggctctgaagtgcagctgctggaatctggcggcggactggtgcagcctggcggatctctgagactgagctgtgccgccagcggcttcaccttcagcacctacgagatgcactgggtgcgccaggcccctggcaaaggactggaatgggtgtccgtgatcctgagcagcggcggagagacaaactacgccgacagcgtgaagggccggttcaccatcagccgggacaacagcaagaacaccctgtacctccagatgaacagcctgcgggccgaggacaccgccgtgtactattgtgccggaatgctgctgccctactacggcatggatgtgtggggccagggcaccaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1801 - DNA, 3150 bp, Artificial Sequence
  Synthetic Polynucleotide encoding a CAR with optional accessory module(s)
atggccttaccagtgaccgccttgctcctgccgctggccttgctgctccacgccgccaggccgggctggtttctggacagccctgacagaccctggaatcctccaacattcagccccgctctgctggtggttaccgagggcgataatgccaccttcacctgtagcttcagcaacaccagcgagagcttcgtgctgaactggtacagaatgagccccagcaaccagaccgacaagctggccgcctttcctgaggatagaagccagcctggacaggactgccggttcagagttacccagctgcctaacggcagagacttccacatgagcgttgtgcgggccagaagaaacgacagcggcacatatctgtgcggagccatctctctggcccctaaggctcagatcaaagagagcctgagagccgagctgagagtgacagaaagacgggccgaagtgcccacagctcacccttcaccttctccaagacctgccggccagttccagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1802 - DNA, 3435 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccaggatgtgtctacagccgtggcctggtatcagcagaagcctggaaaggcccctaagctgctgatctacagcgccagctttctgtacagcggcgtgcccagcagattttctggcagcggctctggcaccgacttcaccctgacaatatccagcctccagcctgaggacttcgccacctactactgccagcagtacctgtatcaccccgccacctttggacagggcaccaaggtggaaatcaagagaggcggaggcggaagtggaggcggaggatctggcggcggaggctctgaagtgcagctggttgaatcaggtggcggcctggttcaacctggcggatctctgagactgagctgtgccgccagcggcttcacctttagcgacagctggattcactgggtccgacaggcccctggcaaaggacttgaatgggtcgcctggatcagcccttatggcggcagcacctattacgccgacagcgtgaagggcagattcaccatcagcgccgacaccagcaagaacaccgcctacctccagatgaactccctgagagccgaagataccgccgtgtactactgcgccagaaggcattggcctggcggctttgattattggggccagggcacactggtcaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1803 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccggccatcgtgatgacccagacaccttctccagtgtctgccgccgttggcggcacagtgacaatcaactgtcaggccagcgagagcgtgtacagcaacaactacctgagctggttccagcagaagcccggccagcctcctaagctgctgatctacctggcctccacactggcaagcggagtgcccagtagattcaaaggcagcggctctggcacccagttcaccctgacaattagcggcgtgcagtgtgacgatgccgccacctattactgcatcggcggcaagagcagcagcaccgatggcaatgcttttggcggcggaacagaggtggtcgttagaggcggaggcggaagtggaggcggaggatctggcggcggaggctctcaatctctggaagaaagcggaggcagactggtcaagcccgacgagacactgaccatcacctgtaccgtgtccggcatcgacctgagcagcaatggactgacctgggtccgacaagctcctggcgaaggactggaatggatcggcaccatcaacaaggacgccagcgcctactatgcctcctgggccaaaggcaggctgaccatctctaagcccagctccacaaaggtggacctgaagatcacaagccccaccaccgaggacaccgccacatacttttgtggccggatcgccttcaagaccggcacctctatttggggacctggcacactggtcaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1804 - DNA, 3432 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggcgctgaagtgaagaaacctggggcctctgtgaaggtgtcctgcaaggcttccggctacacctttaccagctacgacgtgcactgggtccgacaggctccaggacaaagactggaatggatgggatggctgcacgccgataccggcatcaccaagttcagccagaaattccagggccgcgtgacaatcaccagagacacatctgccagcaccgcctacatggaactgagcagcctgagaagcgaggacaccgccgtgtactactgcgccagagagagaatccagctttggttcgactactggggccagggaaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1805 - DNA, 3489 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgatgacccagagccccctgagcctgcctgtgacacctggcgagcctgccagcatctcctgtagaagcagccagagcctgctgcacagcaacggctacaactacctcgtgtggtatctccagaagcccggccagagccctcaactgctgatctacctgggcagcatcagagccagcggcgtgcccgatagattttccggcagcggctccggcaccgacttcaccctgaagatcagccgggtggaagccgaggacgtgggcgtgtactactgtatgcagcccctccagacccccatcaccttcggccagggcaccagactggaaatcaagagaggcggaggcggaagtggaggcggaggatctggcggcggaggctctggactccagtgtgtggccgctcctagatgggtgctgagccaggtgcaactccagcagtggggagccggactgctgaagcctagcgagacactgagcctgacatgcgccgtgtacggcggcagcttcagcggcaattactggtcctggatcagacagccccctggcaagggcctggaatggatcggcgagatcaaccacagcggcagcaccaactacaaccccagcctgaagtccagagtgaccatcagcgtggacaccagcaagaaccagttctccctgaagctgagcagcgtgacagccgccgacaccgccgtgtattactgtgccagaggcggctcctacaattacttcgactactggggccagggaaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1806 - DNA, 3480 bp, Artificial Sequence
  Synthetic Polynucleotide encoding a CAR with optional accessory module(s)
atggccttaccagtgaccgccttgctcctgccgctggccttgctgctccacgccgccaggccggaccagctgacacagagccctagcagcgtgtcagccagcgtgggcgacagagtgaccatcacctgtagagccagccggggcatcagctcttggctggcctggtatcagcagaagcccggcaaggcccccaagctgctgatctacacagccagcagcctccagagcggcgtgcccagcagattttctggcagcggctccggcaccgacttcaccctgacaatcagcagcctccagcccgaggacttcgccacctactactgccagcaggcttacagcttcccccggacctttggccagggcaccaaggtggaaatcaagcggggcggaggcggaagtggaggcggaggatctggcggcggaggctctgtggctgctcctagatgggtgctgagccaggtgcagctccaggaatctggccccggactcgtgaagcctagccagaccctgagcctgacctgtaccgtgtctggcggcagcatcagcagcggcggctactactggatctggatcagacagcaccctggcaagggcctggaatggatcggctacatctactacaacggcaacacctactataaccccagcctgaagtcccgcgtgaccatgagcgtggacaccagcaagaaccagttctccctgaagctgtccagcgtgacagccgccgataccgccgtgtactactgcgccagagatggcatcaccatgatccggggctactattacggcatggacgtgtggggccagggaaccaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1807 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggacatcgtcgtgacacagagccctgcttccctggccgtgtccctgggacagagagccaccatcagctaccgggccagcaagagcgtgtccaccagcggctacagctacatgcactggaaccagcagaagcccggccagccccctagactgctgatctacctggtgtccaacctggaaagcggcgtgcccgccagattttctggcagcggctctggcaccgacttcaccctgaacatccaccccgtggaagaagaggacgccgccacctactactgccagcacatcagagagctgaccagaagcgagggcggaccctcttggaagggcggaggcggaagtggaggcggaggatctggcggcggaggctctgaagtgaagctggaagagtctggcggcgaccttgtgaagcctggcggcagcctgaagctgagctgtgccgccagcggctttaccttctccggctacggcatgagctgggtgcgccagacccccgacaagagactggaatgggtggcaaccatcagcagcggcggcagctacacctactatcccgacagcgtgaagggccggttcaccatctccagagacaacgccaagaacaccctgtacctgcagatgtcctccctgaagtccgaggacaccgccatgtactattgcgccaggcacgaaggcggctactacggcagttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1808 - DNA, 3450 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcagcctgtctgccagcgtgggcgacagagtgaccatcacctgtagagccagccagggcatcagcaactacctggcctggtatcagcagaaaaccggcaaggtgcccaagttcctgatctacgaggccagcaccctgcagagcggcgtgccaagtagattttccggcggaggcagcggcaccgacttcaccctgacaatcagctccctgcagcccgaggacgtggcaacctactactgccagaactacaacagcgcccccttcaccttcggccctgggaccaaggtggacatcaagggcggaggcggaagtggaggcggaggatctggcggcggaggctctcaggtgcaactggtggaatctggcggaggcgtggtgcagcctggcagaagcctgagactgagctgtgccgccagcggcttcgccttcagcagatacggaatgcactgggtgcgccaggcccctggcaaaggactggaatgggtggccgtgatttggtacgacggcagcaacaagtactacgccgacagcgtgaagggccggttcaccatcagccgggacaacagcaagaacacccagtacctgcagatgaacagcctgcgggccgaggataccgccgtgtactattgtgccagaggcggcgacttcctgtactactactattacggcatggacgtgtggggccagggaaccaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1809 - DNA, 3423 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctaccagcgtgggcgatagagtgaccctgacctgcaaggccagccaggatgtgggaaccgccgtggactggtatcagcagaagcctggccccagccccaagctgctgatctactgggccagcaccagacacaccggcatccccagcagattttccggcagcggctccggcaccgacttcaccctgacaatcagctccctgcagcccgaggacttcgccgactactactgccagcagtacaacagctaccccctgaccttcggccctgggaccaaggtggacatcaagggcggaggcggaagtggaggcggaggatctggcggcggaggctctgaagtgcaactggtgcagagcggccctgaagtgaagaaacccggcgctaccgtgaagattagctgcaagaccagcggctacaccttcaccgagtacaccatccactgggtcaagcaggcccctggcaagggcctggaatggatcggcaacatcaaccccaacaacggcggcaccacctacaaccagaagttcgaggacaaggccaccctgaccgtggacaagagcaccgacaccgcctacatggaactgagcagcctgcggagcgaggataccgccgtgtactattgtgccgccggatggaacttcgactactggggacagggcaccctgctgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1810 - DNA, 3426 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacatctacccctacctgaactggttccagcagaagcccggcaaggcccccaagaccctgatctaccggaccaacagactgctggacggcgtgcccagcagattttctggcagcggctccggcaccgacttcaccttcaccatcagctccctccagccctactactgcctccagtacgacgagttccccctgacctttggagccggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcaccagcaacatgggcgtgggctggatcagacagcctcccggaaaagccctggaatggctggcccacatttggtgggacgacgacaagtactacagccccagcctgaagtcccggctgacaatcaccaaggacaccagcaagaaccaggtggtgctgaccatgaccaacatggaccccgtggacaccgccacctactattgcgtgcggagcaactacggctacgcttggtttgcctactggggccagggcaccctcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1811 - DNA, 3426 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccagaaattcatgagcaccagcgtgggcgacagagtgaacgtgacctgcaaggccagccagaacgtgggcaccaacgtcgtgtggtatcagcagaaaaccggccagagccccaaggccctgatccacagcgccagctacagatacagcggcgtgcccgacagattcaccggcagcggctctggcaccgacttcaccctgaccctgagcaacgtgcagagcgaggacctggccgaatacttctgccagcactacaacagcttcccttacaccttcggcggaggcaccaagctggaaatcaagagaggcggaggcggaagtggaggcggaggatctggcggcggaggctctcaggtgcaactccagcagagcggagccgaactcgtgcggcctggcgtgtccgtgaagattagctgcaagggctccggctacaggttcaccgactaccccatccactgggtcaagcagagccacgccaagagcctggaatggatcggcatcatcagcacctactacggcgacgtgaccaacaaccccaagttccggggcaaggccaccatgacagtggacaagagcagcaccaccgcctacatggaactggcccggctgaccagcgaggactccgccatctactactgcgcccggaacgacctgttcgcctattggggccagggcaccctcgtgacagtgtctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1812 - DNA, 3435 bp, Artificial Sequence
  Synthetic Polynucleotide encoding a CAR with optional accessory module(s)
atggccttaccagtgaccgccttgctcctgccgctggccttgctgctccacgccgccaggccggacatcaagatgacccagagccccagctctatgtacgccagcctgggcgagcgcgtgaccatcacctgtaaagccagccccgacatcaacagctacctgagctggttccagcagaagcccggcaagagccccaagaccctgatctaccgggccaacagactggtggatggcgtgcccagcagattctctggcggcggaagcggccaggactacagcctgaccatcaactccctggaatacgaggacatgggcatctactactgcctccagtacgacgagttcccctacaccttcggcggaggcaccaagctggaaatgaaaggcggaggcggaagtggaggcggaggatctggcggcggaggctctgaagtgaagctggtggaatcaggaggaggcctcgtgaaacctggcggctctctgaagctgagctgtgccgccagcggcttcaccttcagcagctacgccatgagctgggtgcgccagattcccgagaagcggctggaatgggtggcctccattagcagaggcggcaccacctactaccccgacagcgtgaagggccggttcaccatctccagagacaacgtgcggaacatcctgtacctccagatgagcagcctgcggagcgaggacaccgccatgtactactgcggcagatacgactacgacggctactacgctatggactactggggccagggcaccagcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1813 - DNA, 3444 bp, Artificial Sequence
  Synthetic Polynucleotide encoding a CAR with optional accessory module(s)
atggccttaccagtgaccgccttgctcctgccgctggccttgctgctccacgccgccaggccggacgacgtggtcgtgacccctgtgtcctgcttcctgagctgcatctctggcgccgagggccaccacctgattcagggccagcagaagtgccagtacatctggctgctgtacgccctggaacccaccgagacaagaaccgccacccagacccctcacctgtcctgcatccagcccagaatctggggaccctgccaggtgcagtggcagtgggtgtgggatagactgcacccccagcaccctagttgtggcggcggaggctgttgcaacctgctgctgtctgcccacggcgcctacacatttggcggaggcacccggctggaactgaaaggcggaggcggaagtggaggcggaggatctggcggcggaggctctgaagtgaagctccaggaaagcggccctgagctcgtgaagcctggcgcctctgtgaagatgagctgcaaggccagcggctacaccttcaccagctacgtgatgcactgggtcaagcagaagcccggccagggcctggaatggatcggctacatcaacccctacaacgacggcaccaagtacaacgagaagttcaagggcaaggccaccctgaccagcgacaagagcagcagcaccgcctacatggaactgagcagcctgacctccgaggacagcgccgtgtactactgcgcccggtggaaaatctactacggcaactacgaggactactggggccagggcacacccctgacagtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1814 - DNA, 3534 bp, Artificial Sequence
  Synthetic Polynucleotide encoding a CAR with optional accessory module(s)
atggccttaccagtgaccgccttgctcctgccgctggccttgctgctccacgccgccaggccggacgaattccaggtgcaactggtgcagtctggcggagggctggtgcagccagggggatctctgagactgagctgtgccgccagcgacttcgacttcgccgcctacgagatgagctgggtgcgccaggctcctggacagggactggaatgggtggccatcatcagccacgacggcatcgacaagtattacaccgacagcgtgaagggccggttcaccatcagccgggacaacagcaagaacaccctgtacctgcagatgaataccctgcgggccgaggacaccgccacctactattgcctgagactgggagccgtgggccagggcacacttgtgacagtgtctagcctcgagggaggaggcggctccgggggaggcggaagtggaggcggaggatctgggtctggaggaagcggatctggaggctcagggtcagggggctcaggcagtggaggcagcttcgaacaggtgcaactggtgcagagcggaggcggactggtgcagcctgggggcagtctgaggctgtcttgtgccgcctccgatttcgccttcgatgattacgagatgtcttgggtgcggcaggccccaggcaaagccctggaatggatcggcgacatcaaccacagcggcaccaccatctacaaccccagcctgaagtccagagtgaccatctccagagacaactccaagaatactctgtacctgcagatgaacacactgagagccgaagatacagccatctactactgcgccagaccccactacggcgactacagcgacgccttcgacatctggggccagggaaccatggtcaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1815 - DNA, 3459 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtccgtgtctccaggcgaaagagccaccctgagctgtagagccagccagagcgtgtccagcaacctggcctggtatcagcagaagcccggccaggctccccggctgctgatctatggcgcttctaccagagccaccggcatccccgccagattttctggcagcggctccggcaccgacttcaccctgacaatcagctccctccagtccgtggacagcgccgtgtactactgccagcagtacaacaactggcccccctacaccttcggccagggcaccaagctggaaatcaagggcggaggcggaagtggaggcggaggatctggcggcggaggctctcaggtgcaactgctggaaagcggagggggcgtggtgcagcctggaagaagcctgagactgagctgtgccgccagcggcttcaccttcagcttctacggaatgcactgggtgcgccaggcccctggcaaaggactggaatgggtggccgccatcagctacgacggcagcaacaagtattacgccgacagcgtgaagggccggttcaccatcagccgggacaacagcaagaacaccctgtacctccagatgaacagcctgcgggccgaggacacagccgtgtattattgcgccaagcggcccaaccagttctactgctccgacggcagatgctacagcatcgactactggggccagggaaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1816 - DNA, 3447 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctcctagtgcctctgccggcggaacacctggacagagagtgaccatctcctgctccggcagcagcagcaacatcggcagcaacttcgtgtactggtatcagcaactgcccggcaccgcccccaagctgctgatctacagaaacaaccagcggcccagcggcgtgcccgatagattctctggaagcagaagcggcaccagcgccagcctggctggactgagaagcgaggacgaggccgactactactgtgccgccgatagcctgggcggccactacgtgttcggcaccggaacaaaagtgctgggcggaggcggaagtggaggcggaggatctggcggcggaggctctcaggtgcaactggtggaatctggcggaggctctgtgcagcctggcagaagcctgagactgagctgtgaagcctccggcttcaccttcgaggcttacgccatgcactgggtgcgccagccacctggcaaaggactggaatgggtgtccagcatcaactggaacagcggcagaatcgcctacgccgacagcgtgaagggccggttcaccatcagccgggacaacgccagaaacagcctgtacctccagatgaacagcctgcggctggaagataccgccttctactactgcgccaaggacatccggcggttcagcacaggcggagccgagtttgagtattggggccagggcaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1817 - DNA, 3432 bp, Artificial Sequence
  Synthetic Polynucleotide encoding a CAR with optional accessory module(s)
atggccttaccagtgaccgccttgctcctgccgctggccttgctgctccacgccgccaggccggagaacgtgctgacacagagccctgccatcatgagcgcttccccaggcgagaaagtgaccatgacatgtagcgccagcagcagcgtgtcctacatgcactggtatcagcagaagtccagcacaagccccaagctgtggatctacgacaccagcaaactggcctctggcgtgccaggcagattttctggcagcggcagcggaaacagctacagcctgacaatcagcagcatggaagccgaggacgtggcaacctactactgctttcaaggcagcggctaccctctgacctttggagccggaacaaagctggaactgaaaggcggaggcggaagtggaggcggaggatctggcggcggaggctctcaggtgcagctgaaagaatctggccctggactggtggcccctagccagtctctgagcatcacctgtaccgtgtccggcttcagcctgagttctcagggcgtgtactgggtccgacagcctcctggaaaaggactggaatggctgggagccatttgggctggcggcagcaccaattacaacagcgccctgatgagccggctgagcatctccaaggacaacagcaagagccaggtgttcctgaagatgaacagcctccagaccgacgacaccgccatgtactactgcgccagagtggatggctaccggggctacaacatggactattggggccagggcaccagcgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1818 - DNA, 3444 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgacgccagcaacctggaaaccggcgtgcccagcagattttccggcagcggctctggcaccgacttcaccttcaccatcagctccctccagcccgaggacattgccacctactactgccagcagtacgacaacctgcccctgacctttggcggaggcaccaaggtggacatcaagagaggcggaggcggaagtggaggcggaggatctggcggcggaggctctcaggtgcaactggtggaatctggcggcggagtggtgcagcctggcagaagcctgagactgagctgtgccgccagcggcttcacctttagcagctacgccatgcactgggtgcgccaggcccctggaaaaggcctggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgtgccagggctcacaacagcagctcttggagcttcgactactggggccagggcaccctcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1819 - DNA, 3471 bp, Artificial Sequence
  Synthetic Polynucleotide encoding a CAR with optional accessory module(s)
atggccttaccagtgaccgccttgctcctgccgctggccttgctgctccacgccgccaggccggacgacgtcgtgatgacccagagccctctgagcctgcctgtgtccctgggcgatcaggccagcatctcctgcagatccagccagagactggtgcacagcaacggcaacacctacctgcactggtatctgcagaagcccggccagagccccaagctgctgatctaccgggtgtccaacagattccccggcgtgcccgatagattcagcggctctggcagcggcaccgacttcaccctgaagatcagccgggtggaagccgaggacctgggcatctatttctgcagccagagcacccacgtgccctacacctttggcggaggcaccaagctggaaatcaagcggggcggaggcggaagtggaggcggaggatctggcggcggaggctctgaagtgcggctgcagcagtctggccccgacctgattaagcctggggccagcgtgaagatgagctgcaaggccagcggctacaccttcaccggctacgtgatgcactgggtcaagcagaggccaggccagggcctggaatggatcggcttcatcaacccctacaacgacgacatccagagcaacgagcggttccggggcaaggccaccctgaccagcgataagagcagcaccaccgcctacatggaactgagcagcctgacctccgaggacagcgccgtgtactactgtgctaggggagccggctacaacttcgacggggcctacagattcttcgacttttggggccagggcaccacactgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1820 - DNA, 3444 bp, Artificial Sequence
  Synthetic Polynucleotide encoding a CAR with optional accessory module(s)
atggccttaccagtgaccgccttgctcctgccgctggccttgctgctccacgccgccaggccggacagctacgagctgacccagcctcctagcgtgtccgtgtctcctggacagaccgccaccatctcttgcagcggcgatcaactgggcgggaagtacggccactggtatcagaagaagcccggccagagccccgtgctggtgctgtaccaggacagaaaacggcctgccggcatccccgagagattcagcggaagcagcagcggcaacaccatcaccctgaccatcagcggcacccaggccgtggatgaggccgactactactgccaggcttgggacaccaatctgggcggcgtgttcggcggaggcaccaaagtgacagtgctgggacagggcggaggcggaagtggaggcggaggatctggcggcggaggctctcaggtgcaactggtggaaagcggagccgaagtgaagaaacctggggccagcgtgaaggtgtcctgcaaggccagcggctacacctttaccggctactacatgcactgggtgcgccaggctccaggccagggactggaatggatgggccggatcaaccccaatagcggcggcaccaactacgcccagaaattccagggcagagtgaccatgaccagagacaccagcatcagcaccgcctacatggaactgagccggctgagaagcgacgacaccgccgtgtactactgcgccagccctagaggcagaggcagcgccttcgatatttggggccagggcacactcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1821 - DNA, 3453 bp, Artificial Sequence
  Synthetic Polynucleotide encoding a CAR with optional accessory module(s)
atggccttaccagtgaccgccttgctcctgccgctggccttgctgctccacgccgccaggccggacaacttcatgctgacccagccccacagcgtgtccgagagccctggcaagaccgtgaccatctcctgcaccagaagcagcggctctatcgccagcaaatacgtgcagtggtatcagcagaggcccggcagcagccctaccaccgtgatctacgaggacaaccagaggcctagcggcgtgcccgatagattcagcggcagcatcgacaccagcagcaacagcgccagcctgaccatcagcggcctgagaacagaggacgaggccgactactactgccacagctacgacagcaacaaccactccgtgttcggcggaggcaccaaagtgacagtgctgggacagggcggaggcggaagtggaggcggaggatctggcggcggaggctctgaagtgcaactggtggaaagcgggggaggcgtggtgcagccaggcggatctctgagactgagctgtgccgccagcggcttcaccttcagcagctacgccatgagctgggtgcgccaggcccctggaaaaggcctggaatgggtgtccgccatctctggctctggcggcagcacctactacgccgatagcgtgaagggccggttcagcatcagccgggacaacagcaagaacaccctgtacctccagatgaacagcctgcgggccgaggacaccgccgtgtactactgtgccagaaccagaagctccggggccttcgacatctggggccagggaacactcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1822 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccggacatccagatgaaccagagccccagcagcctgagcgccagcctgggcgataccatcaccatcacctgtcacgccagccagaacatcaacgtgtggctgagctggtatcagcagaagcccggcaacatccccaagctgctgatctacaaggccagcaacctgcacaccggcgtgcccagcagattttctggcagcggctctggcaccggcttcaccattaccatcagctccctccagcccgaggacattgccacctactactgccagcagggccagagctacccctggacatttggcggaggcaccaagctggaaatcaagagaggcggaggcggaagtggaggcggaggatctggcggcggaggctctgaagtgcaactccagcagagcggcccagagcttgtgaagcctggcgcttccgtgaagattagctgcaaagccagcggctacagcttcaccggctacttcatgaactgggtcaagcagagccacggcaagagcctggagtacatcggcagattcaacccctacaacggcgagacactgtacaaccagaagttcaagggcaaggccaccctgaccgtggacaagagcagcagcaccgtgcacatggaactgctgagcgtgaccagcgaggacagcgccgtgtactactgtggcagaagcggcaacgacgacgctatggactattggggccagggcaccagcgtgaccgtgtctagtgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1823 - DNA, 3441 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcatcctgagcgccagcgtgggcgacagagtgaccatcacctgtcgggccagccagagattcggcgactacctggcctggtatcagcagaagcctggacaggcccccaagctgctgatctacggcgcttccacactccagagcggcgtgcccagcagattttctggcagcggctccggcaccgagttcaccctgacaatcagcggcctccagcccgaggacttcgccacctactattgccagcaggccaacagcttccctatcaccttcggcaagggcacccggctggacatcagaagaggcggaggcggaagtggaggcggaggatctggcggcggaggctctcaggtgcagctggtgcagtctggggccgaagtgaagaaacccggcagcagcgtgaaggtgtcctgcaaggcttccggcggcaccttcagcagctacgccatttcttgggtgcgccaggccccaggacagggcctggaatggatgggctggatcaacgtgggcaacggcaacgccatctacagccagaaattccagggccgcgtgacaatcaccagagacaccagcgccaccaccgcctacatggaactgagcagcctgcggagcgaggacaccgccgtgtactactgtgccagggatggcgagagagcctgggacctggattattggggccagggcacactcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1824 - DNA, 3456 bp, Artificial Sequence
  Synthetic Polynucleotide encoding a CAR with optional accessory module(s)
atggccttaccagtgaccgccttgctcctgccgctggccttgctgctccacgccgccaggccggacgagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctacacattcggccagggcaccaagctggaaatcaagagaggcggaggcggaagtggaggcggaggatctggcggcggaggctctcaggtgcaactggtgcagtctggcggcggagtggtgcagcctggaagaagcctgagactgtcctgtgccgccagcggcttcaccttcagcagctacgccatgcactgggtgcgccaggcccctggaaaaggactggaatgggtggccgtgatctcctacgacggcagcaacaagtattacgccgacagcgtgaagggccggttcaccatctccagagacaacagcaagaacaccctgtacctccagatgaacagcctgcgggccgaggacacagccgtgtattattgcgccagagagctgcggttcctggaatggtccagcgacgccttcgacatctggggccagggaacaatggtcaccgtgtcctccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1825 - DNA, 3441 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctgccaccctgtctctgagccctggcgaaagagccaccctgagctgtagagccagccagagcgtgcggagctacctggcctggtatcagcagaagcctggacaggcccccagactgctgatctacgacgccagcaatcgggccacaggcatccccgccagattttctggctctggcagcggcaccgacttcaccctgacaatcagcagcctggaacccgaggacttcgccgtgtactactgccagcagcggagcaactggccccctacctttggacagggcaccaaggtggaaatcaagggcggaggcggaagtggaggcggaggatctggcggcggaggctctcaactccaggtgcaggaatctggccccggactcgtgaagcccagcgagacactgagcctgacctgtaccgtgtccggcggcagcatcagcaacagctacttctcctggggctggatcagacagccccctggcaagggcctggaatggatcggcagcttctactacggcgagaaaacctactacaaccccagcctgaagtccagagccaccatcagcatcgacaccagcaagagccagttctccctgaagctgagcagcgtgacagccgccgacaccgccgtgtattattgccccagaggccccaccatgatccggggcgtgatcgactcttggggccagggaacactcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1826 - DNA, 3432 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggtgccgaagtgcggaagcctggcagctctgtgaaggtgtcctgtaaagcctccggcggcagcttcaacaactaccccatcttctgggtccgacaggcccctggacagggctttgaatggatgggcagaatcatccccatcctgggcatcaccgcctacgctcagaaattccagggccgcgtgacaatcaccgccgacaagtctacaagcacagcctacatggaactgaacagcctgcggagcgaggacaccgccgtgtattattgtgccggcggagatgacctggacgcctttgacatttggggccagggaacaatggtgtccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1827 - DNA, 3468 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacccccctgagcctgcctgtgacacctggcgagcctgccagcatctcctgcagaagcagcagaagcctgctggacagcgacgacggcaacacctacctggactggtatctgcagaaacccggccagagcccccaactgctgatctacaccctgagctacagagccagcggcgtgcccgatagattttccggctctggcagcggcaccgacttcaccctgaagatcagccgggtggaagccgaggacgtgggcgtgtactactgtatgcagcgggtggaatttcccatcaccttcggccagggcaccagactggaaatcaagagaggcggaggcggaagtggaggcggaggatctggcggcggaggctctcaggtgcaactggtggaatctggcgggggagtggtgcagcctggcagatccctgagactgagctgtgccgccagcggcttcatcttcagcagatacggaatgcactgggtgcgccaggcccctggcaagggactgaaatgggtggccgtgatttggtacgacggcagcaacaagctgtacgccgacagcgtgaagggccggttcaccatcagcagagacaacagcaagaacaccctgtacctgcagatgaacagcctgcgggccgaggacaccgccgtgtactattgcgccagagactactacgacaacagccggcaccactggggcttcgactattggggccagggaacccttgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1828 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccggagatccagatgacccagagccccagcagcatgtctgccagcctgggcgacaccatcaccatcacatgccaggccacccaggacatcttcaagaacctgaactggtatcagcagaagcccggcaagccccccagcctgctgatctactatgccaccgaactggccgagggcgtgcccagcagattttctggcagcggcagcggctccgactacagcctgaccatcagcaacctggaaagcgaggacttcgccgcctactactgcctccagttcttcgagttcccattcaccttcggctccggcaccaagctggaaatgaagggcggaggcggaagtggaggcggaggatctggcggcggaggctctcaggtgcaactccagcagtctggcgctgagcttgtgcggcctggcacctctgtgaaggtgtcctgtaaagccagcggctacgtgttcaccaactactggatcgagtggatcaagcagcggccaggccagggcctggaatggatcggcgtgatgaatccaggcagcggcgagacaacctacaacgagaagttcaagggcaaggccaccctgaccgccgacaagagcagcagcacagcctacatgcaactgtcctccctgaccagcgtggacagcgccgtgtacttctgcgccagggaccacgaccgggactactacgctatggactactggggccagggcaccagcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1829 - DNA, 3429 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacacagagccccgccatcctgtccgtgtctccaggcgagagagtgtcctttagctgccgggccagccagaacatcggcaccagcatccactggtatcagcagcggaccaacggcagccccagactgctgattaagtacgccagcgagtccgtgtccggcatccccagcagattttctggcagcggctccggcaccgacttcaccctgagcatcaacagcgtggaaagcgaggacattgccgactactactgccagcacaccaatagctggcccaccacctttggcggaggcaccaagctggaaatcaagagaggcggaggcggaagtggaggcggaggatctggcggcggaggctctcaggtgcaactccagcagtccgacgccgagcttgtgaagcctggcgcttccgtgaagattagctgcaaggccagcggctacaccttcaccgaccacgccattcactgggtcaagcagaagcccgagcagggcctggaatggatcggctacttcagccccggcaacggcgacatcaagtacaacgagaagttcaagggcaaggccaccctgaccgccgacaagagcagcagcacagcctacatgcaactgaacagcctgaccagcgaggactccgccgtgtacttctgcaagcggagctacggcaactacgactactggggccagggcaccacactgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1830 - DNA, 3444 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgcaagagcagccagagcctgctgaacagcggcgaccagaagaactacctgacctggtatcagcagaagcccggccagccccccaagctgctgatctactgggccagcaccagagaaagcggcgtgcccgatagattcagcggcagcggaagtggcaccgacttcaccctgaccatcagttctcttcaggccgaggacgtggccgtgtactactgccagaacgactacagctaccccctgaccttcggccagggcaccaaggtggaaatcaagggcggaggcggaagtggaggcggaggatctggcggcggaggctctcaggtgcagctggtgcagtctggggccgaagtgaagaaaaccggcagcagcgtgaaggtgtcctgcaaggccagcggctacacctttaccgaccacgccattcacgtgtggcggcaggctccaggacaggccctggaatggatgggccacttcagccccggcaacaccgacatcaagtacaacgacaagttcaagggcagagtgaccctgaccgtggaccgcagcatgagcaccgcctacatggaactgagcagcctgcggagcgaggacaccgccatgtactattgcaagaccagcaccttctttttcgactactggggccagggaacaatggtcaccgtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1831 - DNA, 3210 bp, Artificial Sequence
  Synthetic Polynucleotide encoding a CAR with optional accessory module(s)
atggagctgactgaattgctcctcgtggtcatgcttctcctaactgcaaggctaacgctgtccagcccggctcctcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggaccctaatgccatcttcctgagcttccaacacctgctccgaggaaaggtgcgtttcctgatgcttgtaggagggtccaccctctgcgtcaggcgggccccacccaccacagctgtccccagcagaacctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1832 - DNA, 3441 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgtccattgccgtggcctggtatcagcagaagcccggcaaggcccccaaggtgctgatctacagcgccagctacagatacaccggcgtgcccgacagattcagcggctctggcagcggcaccgacttcaccttcaccatcagctccctccagcccgaggatattgccgtgtactactgccagcagcactacatcacccccctgacctttggcggaggcaccaaggtggaaatcaagggcggaggcggaagtggaggcggaggatctggcggcggaggctctcagatccaactggtgcagagcggccacgaagtgaagaaacctggggccagcgtgaaggtgtcctgcaaagccagcggctacacctttaccaactacggcatgaactgggtgcgccaggcccctggacagggcctggaatggatgggctggatcaacaccaagaccggcgagcccacctacgccgaagagttcaagggcagattcgtgttcagcctggaaaccagcgcctccaccgcctacctccagatcagctctctgaaggccgaggacaccgccatgtacttttgcggcagaggcggctacggcagcagctactggtacttcgatgtgtggggccagggcaccaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1833 - DNA, 3447 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgccgggccagcaagagcgtgtccaccagcggctacagctacatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagagctgccctacaccttcggccagggcaccaagctggaaatcaagggcggaggcggaagtggaggcggaggatctggcggcggaggctctcaggtgcaactccaggaatctggccctggccttgtgaagcccagcgagacactgagcctgacctgtaccgtgtccggcggcagcatcagctcttacggcgtgcactggattcggcagcctccaggcaagggcctggaatggatcggcgtgatctggacctccggcgtgaccgactacaacagcgccctgatgggcagagtgaccatctccgtggacaccagcaagaaccagttcagcctgaagctgagcagcgtgacagccgccgataccgccgtgtattattgcgccagagatggcgactacgaccgctacacaatggactactggggccagggaacccttgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1834 - DNA, 3384 bp, Artificial Sequence
  Synthetic Polynucleotide encoding a CAR with optional accessory module(s)
atgacagccctgttcctgatgtccatgctgttcggcctggcctgcggacaggccatgtctttctgtatccccaccgagtacaccatgcacatcgagagaagagagtgcgcctactgcctgaccatcaacaccacaatctgcgccggctactgcatgacacgggatattaacggcaagctgttcctgcctaagtacgccctgagccaggacgtgtgcacctaccgggacttcatctaccggaccgtggaaatccctggctgccctctgcatgtggccccttactttagctaccccgtggctctgagctgcaagtgcggcaagtgcaacaccgactacagcgactgtatccacgaggccatcaagaccaactactgcaccaagcctcagaaaagctacctcgtgggcttctctgttggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1835 - DNA, 3435 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctcctagcgtgtccgtgtctcctggccagaccgccagcatcacctgtagcggcgataagctgggcgataagtacgcctgctggtatcagcagaagcccggccagtctcccgtgctcgtgatctaccaggacagcaagaggcccagcggcatccccgagagattcagcggcagcaacagcggcaataccgccaccctgaccatcagcggcacccaggctatggacgaggccgactactactgccaggcttgggatagcagcaccgccgtggtgtttggcggaggcaccaagctgacagtgctgggcggaggcggaagtggaggcggaggatctggcggcggaggctctcaggtgcagctggtgcagtctggggccgaagtgaagaagcctggacagagcctgaagatcagctgcaaggccagcggctacagcctgaccgacaactggattggctgggtgcgccagaagccaggcaagggcctggaatggatgggcatcatctaccccggcgacagcgacaccagatacagccctagcttccagggccaagtgaccatctccgccgacaagagcatcaacaccgcctacctccagtggtccagcctgaaagcctccgacaccgccatctactactgtgtgggactggactggaactacaaccccctgcggtactggggacctggcacactcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1836 - DNA, 3429 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccagaaattcatgagcaccagcgtgggcgaccgggtgtccatcatctgcaaggccagccagaacgtgggcaccttcgtggcctggtatcagcagaagcctggccagagccccaagctgctggtgtacagcgccagcaacagatacaccggcgtgcccgatagattcaccggcagcggctctggcaccgacttcaccctgaccatcaacaacatgcagagcgaggacctggccgactacttctgtcggcagtacagcagctacccctacaccttcggcggaggcaccaagctggaaatcaagggcggaggcggaagtggaggcggaggatctggcggcggaggctctgaagtgcaactccagcagagcggccctgagcttgtgaagccaggggccagcatgaagattagctgcaaagccagcggctacagcttcagcgcctacaccatgaactgggtcaagcagagccacggcaagaacctggaatggatcggcctgattaacccctacaacggcggcaccaactacaaccaggaatttgagggcaaggccaccctgacagtgaacaagagcagcaacaccgccttcatggaactgctgagcctgaccagcgacgacagcgccgtgtactactgcgccagacgggactgggactacttcgactattggggccagggcaccacactgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1837 - DNA, 3462 bp, Artificial Sequence
  Synthetic Polynucleotide encoding a CAR with optional accessory module(s)
atggccttaccagtgaccgccttgctcctgccgctggccttgctgctccacgccgccaggccggccatccagatgacccagagccctagcagcctgagcgccagcgtgggcgacagagtgaccatcacctgtagagccagccagagcatcagcaactacctgaactggtatcagcagaagcccggcaaggcccccaagctgctgatctatgccgccagctctctccagagcggcgtgcccagcagattttctggcagcggctccggcaccgacttcaccctgacaatcagcagcctccagcccgaggacttcgccacctactactgccagcagagctacagcagcccctccaccacctttggacagggcaccaagctggaaatcaagagaggcggaggcggaagtggaggcggaggatctggcggcggaggctctgaagtgcagctggtggaatctggcggcggactgattcagcctggcggctctctgagactgagctgtgccgcctctggcttcaccgtgtcctccaactacatgagctgggtgcgccaggcccctggcaagggactggaatgggtgtccgtgacatacagcggcggcagcaccagctacgccgatagcgtgaagggccggttcaccatcagccgggacaacagcaagaacaccctgtacctccagatgaacagcctgcgggccgaggacaccgccgtgtactattgtgccaggggaggccggtactgctccagcatcagctgctatgccagaagcggctgcgactactggggccagggaacactcgtgaccgtgtccagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1838 - DNA, 3447 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcggcaccagcctgcactggtatcagcagaagcctggcaaggcccccaagctgctgattaagttcgccagcagactgcagagcggcgtgcccagcagattttctggcagcggctccggcaccgacttcaccctgacaatcagctccctgcagcccgaggacttcgccacctactactgccagcagagccccggcttccctccaacctttggacagggcaccaagctggaaatcaagcggggcggaggcggaagtggaggcggaggatctggcggcggaggctctcaggtgcaactggtggaatctggcggcggacttgtgaagccaggcggcagcctgagactgagctgtgccgccagcggcttcagcatcaccaccagcggctactactggacctggatcagacagttccccggcaagggcctggaatggatgggctacatcggctacaacagcaagacctactacaaccccgccctgaagtcccggatcaccatcagcagagacaacgccaagaacagcctgtacctgcagatgaactccctgagagccgaggataccgccgtgtactactgcgccagatccctgtacggcggctacaaggacgccttcgatagctggggccagggaacccttgtgaccgtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1839 - DNA, 3462 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacccagagccctctgagcctgcctgtgacacctggcgagcctgccagcatctcctgtagaagcagccagagcctgctgcacagcatcggctacaactacctggactggtatctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagacccccctgacctttggcggaggcaccaaggtggaaatcaagcggggcggaggcggaagtggaggcggaggatctggcggcggaggctctgaagtgcaactggtggaaagcggaggcggcgtggtgcagcctggaagaagcctgagactgagctgtgccgccagcggcttcaccttccggtcctacggaatgcactgggtgcgccaggcccctggcaaaggactggaatgggtggccgtgatctcctacgacggctccaacaagtactacaccgacagcgtgaacggcagattcaccatcagcagagacaacagcaagaacaccctgtacctccagatgaacagcctgcgggccgaggacaccgccgtgtactattgtgctagaggcggaggctactacgagacaagcggccctgattactggggccagggcacactcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1840 - DNA, 3456 bp, Artificial Sequence
  Synthetic Polynucleotide encoding a CAR with optional accessory module(s)
atggccttaccagtgaccgccttgctcctgccgctggccttgctgctccacgccgccaggccggacgacgtcgtgatgacccagagccctctgagcctgcctgtgacacctggcgagcctgccagcatctcctgtagaagcagccagagcctgctgcacagcatcggctacaactacctgcactggtttctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagacccctcccacctttggacagggcaccagactggaaatcaagcggggcggaggcggaagtggaggcggaggatctggcggcggaggctctcaactccaactccaggaaagcggccctggcctcgtgaagcctagcggcacactgagcctgacatgtgccgtgtctggcggcagcatcagcagcagcaactggtggtcttgggtgcgccagcctcctggcaagggcctggaatggatcggcgaaatctaccacagcggcagcaccaactacaaccccagcctgaagtccagagtgaccatcagcgtggacaagagcaagaaccagttctccctgaagctgagcagcgtgacagccgccgataccgccgtgtactattgcgtgggcagcccctacggcgactacgtgctggattattggggccagggcaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1841 - DNA, 3465 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagagccctctgagcctgcctgtgacacctggcgagcctgccagcatcagctgtagaagcagccagagcctgctgcacagcaacggccacaactacctggactggtatctccagaagcccggccagagcccccagctgctgatctacctgggcagcaatagagccagcggcgtgcccgatagattcagcggctctggaagcggcaccgacttcaccctgaagatcagccgggtggaagccgaggacgtgggcgtgtactactgtatgcagaccctccagacccccctgacctttggccctggcaccaaggtggacatcaagagaggcggaggcggaagtggaggcggaggatctggcggcggaggctctgaagtgcagctggtggaaacaggcggaggcgtggtgcagcctggcagaagcctgagactgagctgtgccgccagcggcttcaccttcagcagctacggaatgcactgggtgcgccaggcccctggcaaaggactggaatgggtggccgtgatctcctacgacggcagcaacaagtattacgccgacagcgtgaagggccggttcaccatctccagagacaacagcaagaacaccctgtacctccagatgaacagcctgcgggccgaggacaccgccgtgtactattgcgccaaggacagatacggctggggcagcagcttcggccacttcgattattggggccagggcaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1842 - DNA, 3450 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctggcaccctgagcctgtctctgggagagagagccacactgagctgtcgggccagccagtctatcagcagcagcttcctggcctggtatcagcagaagcccggccaggcccctaagctgctgatctacgccgccagcacaagagccaccggcatccccgatagattcagcggctctggcagcggcaccgacttcaccctgaccatcagcagactggaacccgaggacttcgccgtgtactactgccagcagtacggcagaagcctgagcttcggcggaggcaccaaggtggaagtgaagggcggaggcggaagtggaggcggaggatctggcggcggaggctctcaggtgcaactccagcagtctggccccggactcgtgaagcctagccagacactgagcctgacctgcgccatcagcggcgatagcgtgtccggcaatagcgccacctggaactggatcagacagagcccatctcggggcctggaatggctgggccggacctactaccgcagcaagtggaaccacgactacgccgagagcgtgaagtcccggatcaccatcaaccccgacaccagcaagaaccagttctccttgcaactgaacagcgtgacccccgaggacacagccgtgtattattgcgccagaggcgacagcagctcttggtacgccttcgactattggggccagggcaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1843 - DNA, 3450 bp, Artificial Sequence
  Synthetic Polynucleotide encoding a CAR with optional accessory module(s)
atggccttaccagtgaccgccttgctcctgccgctggccttgctgctccacgccgccaggccggaccagaccgtcgtgacacagcctcctagcgcctctggcacaccaggccagagagtgaccatctcctgtagcggcagcagcagcaacatcggcagcaactacgtgtactggtatcagcaactgcccggcaccgcccccaagctgctgatctacagaagcaaccagcggcccagcggcgtgcccgatagattttctggcagcaagagcggcaccagcgccagcctggctatctctggacctagaagcgtggacgaggccgactactactgcgccgcctgggacgatagcctgaacggcgtggtgtttggcggaggcaccaagctgacagtgctgggtggcggaggcggaagtggaggcggaggatctggcggcggaggctctcaggtgcaactggtgcagtctggggccgaagtgaagaaacccggcagctccgtgaaggtgtcctgcaaggcttccggcggcaccttcagcagctacgccatttcttgggtgcgccaggcccctggacagggcctggaatggatgggcggcatcatccccatctttggcaccgccaactacgcccagaaattccagggccgcgtgaccatcaccgccgacgagtctacaagcaccgcctacatggaactgagcagcctgcggagcgaggataccgccgtgtactactgtgccagaagaatccccccctactacggcatggacgtgtggggccagggaaccaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1844 - DNA, 3450 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtcgtgacacagcctcctagcgtgtcagtggcccctggcaagaccgccagaatcacctgtggccggaacaacatcggcagcaagagcgtgcactggtatcagcagaagcccggccaggctcctgtgctggtggtgtacgacgacagcgacagacccagcggcatccccgagagattcagcggcagcaactccggcaataccgccaccctgaccatcagcagagtggaagccggcgacgaggccgactactactgccaagtgtgggacagcagcagcgatcacgtggtgtttggcggaggcaccaagctgacagtgctgggtggcggaggcggaagtggaggcggaggatctggcggcggaggctctgaagtgcaactggtgcagtctggcggaggggtcgtgcggcctggcggatctctgagactgtcttgtgccgccagcggcttcaccttcgacgactacggcatgagctgggtgcgccaggcccctggaaaaggcctggaatgggtgtccggcatcaactggaatggcggcagcaccggctacgccgattctgtgcggggcagattcaccatcagccgggacaacgccaagaacagcctgtacctgcagatgaactccctgcgggccgaggacaccgccctgtactattgcgccagagagcggggctacggctaccacgaccctcacgattattggggccagggcacccttgtcaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1845 - DNA, 3486 bp, Artificial Sequence
  Synthetic Polynucleotide encoding a CAR with optional accessory module(s)
atggccttaccagtgaccgccttgctcctgccgctggccttgctgctccacgccgccaggccggaacagaaactcatcagtgaagaagacctggaattccaggctgtcgtgacacagcctcctagcgcctctggcacaccaggccagagagtgaccatctcctgtagcggcagcagcagcaacatcggcagcaacaccgtgaactggtatcagcaggtgcccggcaccgctcccaagctgctgatctacagcaacaaccagcggcccagcggcgtgcccgatagattttctggcagcaagagcggcaccagcgccagcctggctatctctggactccagtccgaggacgaggccgactactattgcgccgcctgggacgatagcctgaacggctgggtgttcggcggaggcaccaagctgacagtgctgggcggaggcggaagtggaggcggaggatctggcggcggaggctctcagatgcaactggtgcagagcggagccgaagtgaaagagcctggcgagagcctgcggatctcctgcaagggcagcggctacagcttcaccaatttctggatctcttgggtgcgccagatgcccggcaagggcctggaatggatgggcagagtggaccccggctactcctacagcacctacagccctagcttccagggccacgtgaccatcagcgccgacaagagcaccagcaccgcctacctccagtggaacagcctgaaggccagcgacaccgccatgtactactgcgccagagtgcagtacagcggctattacgattggttcgacccctggggccagggcacactcgtgacagtgtcaagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1846 - DNA, 3468 bp, Artificial Sequence
  Synthetic Polynucleotide encoding a CAR with optional accessory module(s)
atggccttaccagtgaccgccttgctcctgccgctggccttgctgctccacgccgccaggccggaacagaaactcatcagtgaagaagacctggaattcgacatccagatgacccagagccccagcacactgagcgccagcgtgggcgacagagtgaccatcacctgtcgggccagccagaacatcaacaagtggctggcctggtatcagcagaggcccggaaaagccccccagctgctgatctacaaggccagcagcctggaaagcggcgtgcccagcagattttctggcagcggctctggcaccgagtacaccctgaccatcagctccctccagcccgacgacttcgccacctactactgccagcagtacaacagctacgccaccttcggccagggcaccaaggtggaaatcaagagaggcggaggcggaagtggaggcggaggatctggcggcggaggctctcaggtgcagctggtgcagtctggggccgaagtgaagaagcctggcgagagcctgaagatcagctgcaagggctccggctacaacttctctaacaagtggatcggctgggtgcgccagctgcctggcagaggactggaatggatcgccatcatctaccccggctacagcgacatcacctacagccccagcttccagggccgcgtgacaatcagcgccgacaccagcatcaacaccgcctacctgcactggcacagcctgaaggccagcgacaccgccatgtactactgcgtgcggcatacagccctggctggcttcgattattggggcctgggcaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1847 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccaatacctacctggcctggtatcaccagaggcccggacaggctccccggctgctgatctatggcgcttctagcagagccaccggcatccccgatagattcagcggctctggcagcggcaccgacttcgccctgacaatcagctccctggaacccgaggacttcgccgtgtactactgccagcagtacagcaactcctggaccttcggccagggcaccaaggtggaaatcaagagaggcggaggcggaagtggaggcggaggatctggcggcggaggctctcaggtgcaactggtggaatctggcgggggagtggtgcagcctggcagaagcctgagactgtcttgtgccgccagcggcttcaccttcagcagctacgacatgcactgggtgcgccaggcccctggcaaaggactggaatgggtggccgtgatctcctacgacggcaccaacgagtattacgccgacagcgtgaagggccggttcaccatctccagagacaccagcaagaacaccctgtacctccagatgaacagcctgcgggccgaggacacagccgtgtattattgcgccagagagcggtacttcgactggtccttcgactactggggccagggaaccctggtgtccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1848 - DNA, 3435 bp, Artificial Sequence
  Synthetic Polynucleotide encoding a CAR with optional accessory module(s)
atggccttaccagtgaccgccttgctcctgccgctggccttgctgctccacgccgccaggccggagctgacacaggaccctgctgtgtctgttgccctgggccagacagtgcggattacctgtcaaggcgacagcctgagaagcaactacgccaactggtatcagcagaagcccggacaggctcccgtgctggttatctacggccagaacaacagacccagcggcatccccgatagattcagcggctctagctctggcaataccgccagcctgacaatcactggcgctcaggctgccgatgaggccgactactactgcgatagcagagtgtccaccggcaatcacgtggtgtttggcggcggaacaaagctgacagtgctcggacaaggcggaggcggaagtggaggcggaggatctggcggcggaggctctgaagttcagctggtgcagagcggagccgaagtgaagaaacctggggcctctgtgaaggtgtcctgcaaggcttccggctacacctttaccagctacgccatgcactgggtccgacaggcacctggacaacggcttgaatggatgggctggatcaacgccggcaacggcaacaccaagtacagccagaaattccagggccgcgtgaccatcaccagagatacaagcgccagcaccgcctacatggaactgtctagcctgagatccgaggacaccgccgtgtactactgtgccagagacatcagctacggcagcttcgactattggggccagggcacactggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1849 - DNA, 3441 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagacaccagccacactgagcgtgacacctggcgattctgtgtccctgagctgtagagccagccagagcatcagcaacaacctgcactggtatcagcagaagtcccacgagagccccagactgctgattaagaacgccagccagtctatcagcggcatccccagcaagtttagcggctctggcagcggcaccgacttcaccctgagaatcaacagcgtggaaaccgaggacttcgggatgtacttctgccagcagagcaatagctggccctacacatttggctccggcaccaagctggaaatcaaaggcggaggcggaagtggaggcggaggatctggcggcggaggctctcaagtgaagctgcaacagagcggacccgagctggttaagccaggcgcttccgtgaagattagctgcaaggccagcggctacagcttcaccggctactacatgcactgggtcaagcagagccacggcaacatcctggactggatcggctacatctacccctacaacggcgtgtccagctacaaccagaagttcaagggcaaagccactctgaccgtggacaagagcagcagcaccgcctacatggaactgagaagcctgaccagcgaggacagcgccgtgtactattgtgccagagagcggggcctgtaccagctcagagcaatggattattggggccagggcaccagcgtgaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1850 - DNA, 3414 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacacagacccctgccatcatgagcgcctctccaggccagaaagtgaccatcacatgtagcgccagcagcagcgtgaactacatgcactggtatcagcagaagctgggcagcagccccaagctgtggatctacgataccagcaaactggcccctggcgtgccagccagattttctggttctggcagcggcaccagctacagcctgacaatcagcagcatggaagccgaggatgccgccagctacttctgccatcagtggtctagctacccctacacctttggctccggcaccaagctggaaatcaaaggcggaggcggaagtggaggcggaggatctggcggcggaggctctgaagttcagctccaagagtctggccccgacctggtcaagcctagccaaagcctgagcctgacctgtaccgtgaccggctacagcatcacaagcggctatggatggcactggatcagacagttccccggcaacaaactggaatggatgggctacatccactacagcggcagcaccacctacaatcccagcctgaagtcccggatcagcatcagcagagacaccagcaagaaccagttcttcctgcaactgaacagcgtgaccaccgaggacaccgccacctactattgtgctcggagcctgagatattggggccagggcacaaccctgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1851 - DNA, 3423 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagcgccaccagcagcatcagctacatgcactggtatcagcagaagcccggcaaggcccctaaaggctggatctacgataccagcaaactggcccacggcgtgcccagcagattttctggttctggcagcggcaccgacttcaccctgacaatatctagcctccagcctgaggacttcgccacctactactgccaccagagaagaagctaccccttcaccttcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggcttccggctacacctttaccaatttctggattcactgggtccgacaggctccaggccaaggactggaatggatcggagagatcgaccccagcgacagctacaccaactacaaccagaaattcaaaggccgggtcaccatcaccagagacaccagcacaagcaccgcctacctggaactgagcagcctgagaagcgaggacaccgccgtgtactactgcgccagggaaatcaccaccgtggattattggggccagggaaccctggtcaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1852 - DNA, 3444 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagccagggcttcaacaaatacgtggcctggtatcagcagaagcccggcaaggctcctaagctgctgatctactacaccagcacactccagcctggcgtgcccagcagattttctggctctggcagcggcagagactacaccctgacaatatccagcctccagccagaggacttcgccacctactactgtctccagtacggcaacctgctgtacgcctttggacagggcaccaaggtggaaatcaagagaggcggaggcggaagtggaggcggaggatctggcggcggaggctctgaagttcagcttgtgcagagcggagccgaagtgaagaaacctggggcctctgtgaaggtgtcctgcaaagccagcggctacacctttaccagctactggatcggctgggtccgacaggctcctggacaaggactggaatggatcggcgacatctatcccggcggaggctacaccaactacaacgagaagttcaagggccgcgtgacaatcaccagagacacctctacaagcaccgcctacctggaactgagcagcctgagaagcgaggacaccgccgtgtactactgcgccagactggatggcagcagctacagaggcgctatggattcttggggccagggcacactggtcaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1853 - DNA, 3456 bp, Artificial Sequence
  Synthetic Polynucleotide encoding a CAR with optional accessory module(s)
atggccttaccagtgaccgccttgctcctgccgctggccttgctgctccacgccgccaggccggacatccagctcacacagagcccttctagcctgtctgccagcgtgggcgacagagtgaccatcacatgtagagccagccagagcgtggactacgacggcgacagctacatgaactggtatcagcagaagcccggcaaggcccctaagctgctgatctacgccgccagctatctggaaagcggcgtgccaagcagattttccggctctggcagcggcaccgatttcaccctgacaatatccagcctccagcctgaggacttcgccacctactactgccagcagagccatgaggacccctacacctttggacagggcaccaaggtggaaatcaagagaggcggaggcggaagtggaggcggaggatctggcggcggaggctctgaagtgcaactggttgaatctggcggcggactggttcagcctggcggatctctgagactgagctgtgccgtgtctggctacagcatcaccagcggctactcttggaactggatcagacaggcccctggcaaaggactggaatgggtcgcctccatcacctacgatggcagcaccaactacaaccccagcgtgaagggcagaatcaccatcagcagggacgacagcaagaacaccttctacctgcaaatgaacagcctgagagccgaggacaccgccgtgtactattgtgccagaggcagccactacttcggccactggcattttgctgtgtggggccagggaaccctggtcacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1854 - DNA, 3432 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccaggacatccggtactacctgaactggtatcagcagaagcccggcaaggcccctaagctgctgatctatgtggcctccagcctccagagcggagtgccttctagattttctggcagcggctccggcaccgagtttaccctgacagtgtctagcttgcagcccgaggacttcgccacctactactgcctgcaagtgtacagcacccctcggacctttggacagggcaccaaggtggaaatcaaaggcggaggcggaagtggaggcggaggatctggcggcggaggctctgaagtgcagcttgttgaatctggcggcggactggctaagcctggcggatctctgagactgtcttgtgccgccagcggcttccggttcaccttcaacaactactacatggactgggtccgacaggcccctggacaaggacttgaatgggtgtccagaatcagcagcagcggcgaccctacttggtacgccgattctgtgaagggcagattcaccatcagcagagagaacgccaagaacaccctgttcctccagatgaactccctgagagccgaggacaccgccgtgtactattgtgcctctctgaccaccggcagcgattcttggggacagggcgtgctggttaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1855 - DNA, 3435 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatcggaagcctccagagcgaggacttcgccgtgtactactgccagcagtacaagacctggcctcggacctttggacagggcaccaacgtggaaatcaaaggcggaggcggaagtggaggcggaggatctggcggcggaggctctcaagttcagctgcaacaatggggagccggcctgctgaagcctagcgaaacactgtctctgacctgcgccgtgttcggcggctctttcagcggctactactggtcctggatcagacagcctcctggcaaaggactggaatggatcggcgagatcaaccaccggggcaacaccaacgacaaccccagcctgaaaagcagagtgaccatcagcgtggacaccagcaagaaccagttcgccctgaagctgagcagcgtgacagccgctgataccgccgtgtattattgcgccagagagcggggctacacctacggcaatttcgatcactggggccagggcaccctggtcacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1856 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccctagcagcgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatctctagcctccagagcgaggacttcgccgtgtactactgccaccagtacagcaactggatgtgcagcttcggccagggcaccaagctggaaatcaaaggcggaggcggaagtggaggcggaggatctggcggcggaggctctgaagttcagctccttgagtcaggtggcggcctggttcaacctggcggatctctgagactgagctgtgccgccagcggcttcacctttagcagatacgccatgaactgggtccgacaggcccctggcaaaggactggaatgggtgtccggcatctctggaagcggcggcagaacctactacgccgattctgtgaagggcagattcaccatcagccgggacaacagcaagaacaccctgtacctccagatgaacagcctgagagccgaggacacagccgtgtattattgcgccaaggaccgggacttttggagcggcccttttgactattggggccagggaaccctggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1857 - DNA, 3438 bp, Artificial Sequence; identical to SEQ ID NO: 1856
  Synthetic Polynucleotide encoding a CAR with optional accessory module(s)

SEQ ID NO: 1858 - DNA, 3444 bp, Artificial Sequence
  Synthetic Polynucleotide encoding a CAR with optional accessory module(s)
atggccttaccagtgaccgccttgctcctgccgctggccttgctgctccacgccgccaggccgcaggttcagctccagcagtctgatgccgagctggtcaagcctggcagcagcgtgaagattagctgcaaggccagcggctacaccttcaccgatcacgccatccactgggtcaagcagaagcctgagcagggcctcgaatggatcggccactttagccctggcaacaccgacatcaagtacaacgacaagttcaagggcaaagccacactgaccgtggacagaagcagcagcacagcctacatgcagctgaacagcctgaccagcgaggacagcgccgtgtacttctgcaagaccagcaccttctttttcgactactggggccagggcacaaccctgacagtttcttctggcggaggcggaagtggaggcggaggatctggcggcggaggctctgaactggttatgacacagagccccagcagcctgacagtgacagccggcgagaaagtgaccatgatctgcaagtctagccagagcctgctgaactccggcgatcagaagaactacctgacctggtatcagcagaaacccggccagcctcctaagctgctgatcttctgggccagcaccagagaaagcggcgtgcccgatagattcacaggcagcggcagcggaaccgacttcaccctgacaatcagctctgtgcaggccgaggacctggccgtgtattactgccagaacgactacagctaccctctgacctttggagccggcaccaagctggaactgaagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1859 - DNA, 3447 bp, Artificial Sequence
  Synthetic Polynucleotide encoding a CAR with optional accessory module(s)
atggccttaccagtgaccgccttgctcctgccgctggccttgctgctccacgccgccaggccggaggtgcaactggttgagtctggcggaggactggtgcagcctggaagaagcctgagactgtcttgtgccgccagcggcttcaccttcgacgattatgccatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactactgcgccaaagacaaaggcggaggctactacgacttttggagcggcagcgattattggggccagggcacactggtcacagtgtctagcggcggaggcggaagtggaggcggaggatctggcggcggaggctcttcttctgagctgacacaggaccctgccgtgtctgttgctctgggccagacagtgcggattacctgtcagggcgatagcctgagaagctactacgcctcctggtatcagcagaagccaggccaggctcctgtgctggtcatctacggcaagaacaacagacccagcggcatccccgatagattcagcggaagcagctctggcaataccgccagcctgacaattactggcgctcaggccgaggacgaggccgactactactgcaacagcagagatagcagcggctgggttttcggcggaggcacaaaactgacagtgctgacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1860 - DNA, 3474 bp, Artificial Sequence
  Synthetic Polynucleotide encoding a CAR with optional accessory module(s)
atggccttaccagtgaccgccttgctcctgccgctggccttgctgctccacgccgccaggccggaagtgcagctccagcagtctggacctggcctggttaagcctagccagacactgagcctgacctgtgccatcagcggcgatagcgtgctgagcaacagcgacacctggaactggatcagacagagccctagcagaggactggaatggctgggcagaacctaccacagaagcacttggtacgacgactacgccagctctgtgcggggcagagtgtccatcaatgtggacaccagcaagaaccagtacagcctgcaactgaacgccgtgacacctgaggataccggcgtgtactactgcgccagagacagactccaggacggcaactcttggagcgacgcctttgatgtgtggggccagggcacaatggtcaccgtttctagcggcggaggcggaagtggaggcggaggatctggcggcggaggctctcaatctgctctgacacagcctgccagcgtgtcaggatctcctggacagagcatcaccatctcttgcaccggcaccagctctgatgtcggcggctacaattacgtgtcctggtatcagcagcaccccggcaaggcccctaagctgatgatctacgacgtgtccaacagacccagcggcgtgtccaatagattctccggcagcaagagcggcaacaccgccagcctgacaatttctggactgcaagccgaggacgaggccgactactactgtagcagctacaccagcagcagcacactggtgtacgtgttcggcacaggcaccaaagtgaccgtgcttacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1861 - DNA, 3468 bp, Artificial Sequence
  Synthetic Polynucleotide encoding a CAR with optional accessory module(s)
atggccttaccagtgaccgccttgctcctgccgctggccttgctgctccacgccgccaggccgcaggtgcaactggttcagtctggggccgaagtgaagaaacctggggcctctgtgaaggtgtcctgcaaggcttccggctacacctttaccagctacgacatcaactgggtccgacaggccacaggccaaggactggaatggatgggctggatgaaccccaacagcggcaataccggctacgcccagaaattccagggcagagtgaccatgaccagaaacaccagcatcagcaccgcctacatggaactgagcagcctgagaagcgaggacaccgccgtgtactattgcgccagaggcgacagcaactactggtcctactacggcatggacgtgtggggccagggaacactggttacagtttctagcggcggaggcggaagtggaggcggaggatctggcggcggaggctctggcggtggtggatctcaatctgtgctgacccagcctagatccgtgtctggctctcctggacagagcgtgaccatctcttgtaccggcaccagctctgatgtcggcggctacaattacgtgtcctggtatcagcagcaccccggcgaagcccctaagctgattatctacgacgccgacaagcggcccagcggcatcagcaatagattcagctctggcaagagcggcaacaccgccagcctgacaatcagcggactccaggtggaagatgaggccgactactactgctgctcctatgccggcggaagcacctgggttttcggaggcggtacaaaagtgaccgtgctgacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1862 - DNA, 3474 bp, Artificial Sequence
  Synthetic Polynucleotide encoding a CAR with optional accessory module(s)
atggccttaccagtgaccgccttgctcctgccgctggccttgctgctccacgccgccaggccggaagtgcagctccagcagtctggacctggcctggttaagcctagccagacactgagcctgacctgtgccatcagcggcgatagcgtgtcctctaatagcgccgcctggaactggatcagacagagccctagcagaggactggaatggctgggcagaacctactaccgcagcaagtggtacagcgactacgccgtgtccgtgaagtcccggatcaccatcaatcccgacaccagcaagaaccagttcagcctgcaactgaacagcgtgacccctgaggataccgccgtgtactactgcgccagagatccctacgacttttggagcggctaccccgacgcctttgacatctggggacagggcacaatggtcaccgtttctagcggcggaggcggaagtggaggcggaggatctggcggcggaggctctcaatctgctctgacacagcctgccagcgtgtcaggatctcctggacagagcatcaccatctcttgcaccggcaccagctctgatgtcggcggctacaattacgtgtcctggtatcagcagcaccccggcaaggcccctaaagtgattatcagcgaagtgaacaacagacccagcggcgtgtcccacagattcagcggctctaagtctggcaacaccgccagcctgacaatctctggactgcaagccgaggacgaggccgactacttctgtagcagctacaccagcggcagaaccctgtacgtgttcggcacaggcagcaaagtgacagtgctgggaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1863 - DNA, 3471 bp, Artificial Sequence
  Synthetic Polynucleotide encoding a CAR with optional accessory module(s)
atggccttaccagtgaccgccttgctcctgccgctggccttgctgctccacgccgccaggccggaagtgcagctccagcagtctggacctggcctggttaagcctagccagacactgagcctgacctgtgccatcagcggcgattccatgctgagcaacagcgacacctggaactggatcagacagagccccagcagaggcctggaatggctgggcagaacataccacagaagcacttggtacgacgactacgccagctctgtgcggggcagagtgtccatcaatgtggacaccagcaagaaccagtacagcctgcaactgaacgccgtgacacctgaggataccggcgtgtactactgtgccagagtgcggctccaggacggcaattcttggagcgacgcctttgatgtgtggggccagggcacaatggtcaccgtttctagcggcggaggcggaagtggaggcggaggatctggcggcggaggctctcaatctgctctgacacagcctgccagcgcctctggatctcctggacagagcgtgaccatctcctgtaccggcacctcttctgatgtcggcggctacaactacgtgtcctggtatcagcagcaccccggcaaggcccctaagctgatgatctacgacgtgtccaacagacccagcggcgtgtccaatagattctccggcagcaagagcggcaacaccgccagcctgacaatttctggactgcaagccgaggacgaggccgactactactgtagcagctacaccagcagcagcacactgtacgtgttcggcacaggcacccagctcacagttcttacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1864 - DNA, 3444 bp, Artificial Sequence; identical to SEQ ID NO: 1858
  Synthetic Polynucleotide encoding a CAR with optional accessory module(s)

SEQ ID NO: 1865 - DNA, 3471 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctggaggcggtggaagtggcggcggtggttcaggcggcggaggatctcaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1866 - DNA, 3459 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtccatctacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcctcctttcacattcggccctggcaccaaggtggacatcaaaggcggaggcggaagtggaggcggaggatctggcggcggaggctctcaggtgcagcttgttgaaagcggaggcggagttgtgcagcctggcagaagtctgagactgtcttgtgccgccagcggcttcaccttcagcagctatggaatgcactgggtccgacaggcccctggcaaaggacttgaatgggttgccgtgatctgggacgacggcagcaacaagtattacgtggacagcgtgaagggcagattcaccatcagccgggacaacagcaagaacaccctgtacctccagatgaacagcctgagagccgaggacacagccgtgtattattgcgccagagatgactactacggcagcggctccttcaacagctactatggcacagacgtgtggggccagggcacaacagttaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1867 - DNA, 3414 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctgaagtgcaactggttcaatctggcggcggactggttcatccaggcggttctctgagactgagctgtgccggctctggcttcaccttcagcacctacctgatgtactgggtccgacaggcccctggcaagacactggaatgggtgtccgctattggcagcggaggcgatacctactacgccgactctgtgaagggcagattcaccatcagccgggacaacgccaagaacagcctgtacctccagatgaactccctgagagccgaggacatggccgtgtactactgtgccagaggactcggctattggggccagggaacactggtcacagtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1868 - DNA, 3471 bp, Artificial Sequence
  Synthetic Polynucleotide encoding a CAR with optional accessory module(s)
atggccttaccagtgaccgccttgctcctgccgctggccttgctgctccacgccgccaggccgctgcctgttctgacacagcctccatccgtgtctgtggcccctggaaagaccgccagaatcacatgcggcggcaacaacatcggcagcaagagcgtgcactggtatcagcagaagcctggacaggctcctgtgctggtggtgtacgacgacagcgatagacctagcggcatccccgagagattcagcggcagcaattccggcaataccgccacactgaccatcagcagagtggaagctggcgacgaggccgactactactgccaagtgtgggacagcagcagcgactacgtggtgtttggcggcggaacaaagctgacagtgcttggcggaggcggaagtggaggcggaggatctggcggcggaggctctgaagttcaactggtgcagagcggagccgaagtgaagaagccaggcgagagcctgaagattagctgcaaaggcagcggctacagcttcaccagctactggatcggctgggtccgacagatgcctggcaaaggactggaatggatgggcatcatctaccccggcgacagcgacaccagatacagccctagctttcagggccaagtgaccatctccgccgacaagagcatcagcacagcctacctccagtggtcctctctgaaggccagcgataccgccatgtactactgcgccagacaagtctggggatggcaaggcggcatgtaccccaggtctaactggtggtacaacctggactcttggggccagggcacactggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1869 - DNA, 3441 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctcctagtgtgtctggcgctcctggacagagagtgaccatcagctgtacaggcagcagcagcaatatcggagccggctatgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctctgtgtttggcacaggcacaaaggtgctggtgcttggcggaggcggaagtggaggcggaggatctggcggcggaggctctcaagttcagctggttcagagcggagccgaagtgaagaaacctggcagcagcgtgaaggtgtcctgcaaagcaagcggcggcaccttcagcagctacaccatcaacgtttggagacaggccccaggccagggccttgaatggatgggaggcttcatccctatcagcggcaccgtgaactacgcccagaaattccagggcagagtgacaatcaccgccgacgagagcacaagcaccgcctacatggaactgtccagcctgagaagcgaggacaccgccgtgtactactgtgccagacctctggattggaccgaggacatctggggccagggaacactggtcacagtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1870 - DNA, 3450 bp, Artificial Sequence
  Synthetic Polynucleotide encoding a CAR with optional accessory module(s)
atggccttaccagtgaccgccttgctcctgccgctggccttgctgctccacgccgccaggccgaacttcatgctgacccagcctcacagcgtgtccgagtctccaggcaagaccgtgaccatcagctgtacaggcagcagcggctctatcgccagcaactacgtgcagtggtatcagcagaggccaggcagcgcccctaccatcctgatctacgaggataacaagcggcctagcggcgtgcccgatagattttctggcagcatcgacagcagcagcaacagcgccagcctgacaatcagcggcctgaaaacaggcgacgaggccgactactactgccagagctacgacgacatcaaccactgggttttcggcggaggcaccaagctgacagttcttggaggcggaggcggaagtggaggcggaggatctggcggcggaggctctgaagttcagctggttcagagcggagccgaagtgaagaaacctggggcctctgtgaaggtgtcctgcaaggcttccggctacacctttaccgcctactacctgcactggctgagacaggctccaggccaaggactggaatggatgggctggatgaacaccaacaacggggccaccagatacgcccagaaattccaggacagagtgaccatgaccagagacaccagcatcaacaccgcctacatggaaatgagcggcctgtcctccgacgacaccgccatgtactattgtgccagaggcgacatcagccaggacttcgctgatgtgtggggccagggaacactggtcacagtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1871 - DNA, 3426 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgacacagagccctgccatcatgtccgcttctcccggcgagaaagtgaccatcacatgtagcgccagcagcagcgtgtcctacatgcactggttccagcagaagcccggcacaagccctaagctgtggatctacagcaccagcaatctggcctctggcgtgccagccagattttctggctctggcagcggcaccagctacagcctgacaatcagcagaatggaagccgaggacgccgccacctactactgtcagcagagaagcagctaccctcctacctttggcggaggcaccaagctggaaatcaaaggcggaggcggaagtggaggcggaggatctggcggcggaggctctcaggttcagctccagcagagcggagccgagcttatgaagcctggcgcttccgtgaagatcagctgcaaggccaccggctacaccttcagcagctactggatcgagtgggtcaagcagaggcccggacatggcctggaatggatcggagagatcctgcctggaagcggcagcaccaactacaacgagaagttcaagggcaaagccaccttcaccgccgacaccagcagcaacacagcctatatgcagctgagcagcctgaccagcgaggacagcgccgtgtactactgcgccagatacgactacccttggtttgcctattggggccagggcaccctggttacagtttctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1872 - DNA, 3450 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacacagagccctagcagcctgacagtgacagccggcgagaaagtgaccatgagctgcaagagcagccagagcctgctgaacagcggcaaccagaagaactacctgacctggtatcagcagaagcccggccagcctcctaagctgctgatctactgggccagcaccagagaaagcggcgtgcccgatagattcacaggcagcggcagcggaaccgacttcaccctgacaatcagctctgtgcaggccgaggatctggccgtgtactactgccagaacgactacagctaccccttcacctttggctccggcaccaagctggaaatcaaaggcggaggcggaagtggaggcggaggatctggcggcggaggctctcaagttcagctgcaacagcctggggccgaactcgttagacctggcgcttctgtgaagctgtcctgcaaggccagcggctacacctttaccagctactggatcaactgggtcaagcagcggcctggacagggcctcgaatggatcggcaatatctaccccagcgacagctacaccaactacaatcagaagttcaaggacaaggccacactgaccgtggacaagtctagcagcaccgcctacatgcagctgagcagccctacaagcgaggacagcgccgtgtattattgcacccggtcttggcggggcaacagcttcgattattggggccagggcacaaccctgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1873 - DNA, 3444 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaaggcggaggcggaagtggaggcggaggatctggcggcggaggctctcaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1874 - DNA, 3459 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacacagagccctagcagcctggctatgagcgtgggccagaaagtgaccatgacctgcaagagcagccagagcctgctgaacagcagcaaccagaagaactacctggcctggtatcagcagaagcccggacagtctcctaagctgctggtgtactttgccagcaccagagaaagcggcgtgcccgacagattcatcggctctggaagcggcaccgacttcaccctgacaatcagctctgtgcaggccgaggacctggccgattacttctgtcaccagcactacagcacccctctgacctttggagccggcaccaagctggaactgaaaggcggaggcggaagtggaggcggaggatctggcggcggaggctctgaagttcagctccagcagagcggccctgaccttgtgaaacctggcgcttccgtgaagatgagctgcaaggccagcggctacaccttcaccagctacgtgatgcactgggtcaagcagaaacccggccagggccttgagtggatcggctacatctacccctacaacgatggcaccaagtacaacgagaagttcaagggcaaagccacactgaccagcgacaagtctagcagcaccgcctacatggaactgagcagcctgacctctgaggacagcgccgtgtactactgcgccagagaggaatacggcaactacgtgcggtacttcgacgtgtggggagccggaacaaccgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1875 - DNA, 3441 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggtcacacagcctccatccgtgtctgctgcccctggacagaaagtgaccatcagctgtagcggcagcagcagcaacatcggcaacaactacgtgtcctggtatcagcagctgcccggcacagctcccaaactgctgatctacgacaacaacaagcggcccagcggcatccccgatagattttctgccagcaagagcggcaccagcgccacactgggaatcacaggactccagaccagagatgaggccgactactactgcggcacctgggattcttctctgtccgcctgggttttcggcggaggcacaaaactgacagtgctcggaggcggaggcggaagtggaggcggaggatctggcggcggaggctctcaagttcagctggttcagtctggggccgaagtgaagaaacctggcagcagcgtgaaggtgtcctgcaaggcttccggcgataccttcagcagctactacatcagctgggtccgacaggccccaggacaaggacttgagtggatgggcagaatcatccccatcctgggaatcgccaactacgcccagaaataccagggcagagtgaccctgagcgccgacaagagcacaagcaccagctacatggaactgaacagcctgagcagcgaggacaccgccgtgtactattgtgccctggactggtcctacagcatcgactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1876 - DNA, 3459 bp, Artificial Sequence
  Synthetic Polynucleotide encoding a CAR with optional accessory module(s)
atggccttaccagtgaccgccttgctcctgccgctggccttgctgctccacgccgccaggccggaattcgaagtgaagctggtggaatctggcggcggactggttaagtttggcggcagcctgaagctgagctgtgccgcctctggctttaccctgagcagctactacatgagctgggtccgacagagccccgagaagagactggaactggtggccgtgattaacagcaacggcggcagcacctactatcccgacacagtgaagggcagattcaccatcagccgggacaacgccaagaacaccctgtacctccagatgtctagcctgaagtccgaggacacagccctgtactactgcgccagaccattctactacagcaacagccccttcgcctattggggccagggaacactggttacagtgtctgctggcggaggcggaagtggaggcggaggatctggcggcggaggctctgatgttctgatgacccagacacctctgagcctgcctgtgtctctgggcgatcaggccagcatctcctgtagaagcagccagagcatcgtgcacagaaccggcaacacctacctggaatggtatctccagaagcctgggcagagccccaagctgctgatctacaaggtgtccaacagattcagcggcgtgcccgacagattttctggcagcggctctggcaccgacttcaccctgaagattagcagagtgggagccgaggacctgggcgtctactactgctttcaaggcagccacgtgccatacacctttggcggaggcaccaagctggaaatcaagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1877 - DNA, 3450 bp, Artificial Sequence
  Synthetic Polynucleotide encoding a CAR with optional accessory module(s)
atggccttaccagtgaccgccttgctcctgccgctggccttgctgctccacgccgccaggccggagctggtcatgacacagagccctgcttctctggccgtgtcactgggacagagagccaccatctcttgcagagccagcgagagcgtggacagctacggcaagagcttcatgcactggtatcagctcaagcccggccagcctcctaagctgctgatctacagagcctccaacctggaaagcggcgtgccagccagattttctggcagcggcagcagaaccgacttcaccctgaccattgatcccgtggaagccgatgatgccgccacctactactgccagcagaacaacgaggacccctggacatttggcggaggcaccaagctggaaatcaaaggcggaggcggaagtggaggcggaggatctggcggcggaggctctgaagtgcagctcgaacagtctggccccgagcttgtgaaacctggcgcttccgtgaagatgagctgcaaggccagcggctacaccttcaccaactactacatgaaatgggtcaagcagagccacggcaagtccctggaatggatcggcgatctgaaccccaacaacggcgacaccttctacaaccagaagttcaagggcaaagccacactgaccgtggacaagagcagcaacaccgcctacatgcagctcaactccctgaccagcgaggacagcgccgtgtactactgtgccagaaccggcagatacgaagagaacgctatggactactggggccagggcacaagcgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1878 - DNA, 3432 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1879 - DNA, 3453 bp, Artificial Sequence
  Synthetic Polynucleotide encoding a CAR with optional accessory module(s)
atggccttaccagtgaccgccttgctcctgccgctggccttgctgctccacgccgccaggccggacgtgctgatgacccagacacctgtgtctctgtccgtgtctctgggagatcaggccagcatctcctgtagaagcagccagagcatcgtgcacagcaccggcaacacctacctggaatggtatctccagaagcctggacagagccccaagctgctgatctacaagatcagcaacagattcagcggcgtgcccgacagattttctggcagcggctctggcaccgacttcaccctgaagattagcagagtggaagccgaggacctgggcgtgtactactgcttccaagcctctcacgcccctagaacctttggcggaggcaccaagctggaaatcaagagaggcggaggcggaagtggaggcggaggatctggcggcggaggctctgaagtgatcctggtggaaagcggaggcggccttgtgaaacctggcggatctctgaagctgagctgtgccgccagcggcttcacctttagcagctacacaatgagctgggtccgacagacccctgagaagagactggaatgggtcgccaccatctcttccggcggagggaacacctactatcccgactctgtgaagggcagattcaccatcagccgggacaacgccaagaacaacctgtacctccagatgagcagcctgcggagcgaagatacagccctgtactattgcgcccggtactacagatacgaggcttggtttgcctcttggggccagggcacactggttacagtttctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1880 - DNA, 3063 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggaggactggtgcaggctggaagaagcctgagactgtcttgtgccgccagcgagcacacctttagctctcacgtgatgggctggttcagacaggcccctggcaaagaaagggaaagcgtggccgttatcggctggcgggatattagcaccagctacgccgatagcgtgaagggcagattcaccatcagccgggacaacgccaagaaaaccctgtacctccagatgaacagcctgaagccagaggacaccgccgtgtactactgcgccgccagaagaattgacgccgccgactttgattcttggggccagggaacccaagtgaccgtttctagcgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1881 - DNA, 3060 bp, Artificial Sequence
  Synthetic Polynucleotide encoding a CAR with optional accessory module(s)
atggccttaccagtgaccgccttgctcctgccgctggccttgctgctccacgccgccaggccggaagtgcaactggttgaatccggtggcggcctggtgcaagcaggcggatctctcagacttagctgtgccgcctccggcagaaccttcacaatgggatggtttaggcaggctccagggaaagagagagagttcgtcgccgccatctctctgtctcccacactggcctactacgccgagtctgtgaaaggccggttcaccatctccagagataatgccaagaacaccgtggtgctgcaaatgaactctctgaaacccgaggatacagccctgtactattgtgccgctgaccggaagtccgtgatgagcatcagacccgattactggggacagggcacacaagtcacagtgtcctctgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1882 - DNA, 3462 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggaggactggtgcaggctggaagaagcctgagactgtcttgtgccgccagcgagcacacctttagctctcacgtgatgggctggttcagacaggcccctggcaaagaaagggaaagcgtggccgttatcggctggcgggatattagcaccagctacgccgatagcgtgaagggcagattcaccatcagccgggacaacgccaagaaaaccctgtacctccagatgaacagcctgaagccagaggacaccgccgtgtactactgcgccgccagaagaattgacgccgccgactttgattcttggggccagggaacccaagtgaccgtttctagcggaggcggtggaagtggcggcggtggttcaggcggcggaggatctgaagtgcaactggttgaatccggtggcggcctggtgcaagcaggcggatctctcagacttagctgtgccgcctccggcagaaccttcacaatgggatggtttaggcaggctccagggaaagagagagagttcgtcgccgccatctctctgtctcccacactggcctactacgccgagtctgtgaaaggccggttcaccatctccagagataatgccaagaacaccgtggtgctgcaaatgaactctctgaaacccgaggatacagccctgtactattgtgccgctgaccggaagtccgtgatgagcatcagacccgattactggggacagggcacacaagtcacagtgtcctctgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1883 - DNA, 3054 bp, Artificial Sequence
  Synthetic Polynucleotide encoding a CAR with optional accessory module(s)
atggccttaccagtgaccgccttgctcctgccgctggccttgctgctccacgccgccaggccggaggtgcaactggttgagtctggcggaggactggttcaggcaggcggatctctgagactgagctgtatcgccaccggcaaggtgttcagcatctacgacatgggctggtacagacaggcccctggcaagcagagagagctggttgccgagatcacaagcagcggcaccacacactacgacgacttcgtgtccggcagattcaccatcagccgggacaacgccaagaacaccgtgtacctccagatgaacaccctgaaggccgaggacaccgccgtgtactactgtagagccaaccacgtgttcggcggcagctattggggacagggaacccaagtgacagtgtctagtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1884 - DNA, 3072 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagcttgttgaaagcggaggtggcctggttcaacctggcggaagcctgagactgtcctgtgaagccagcggctttaccctggactactacgccatcggctggtttagacaagctcccggcaaagagagagagggcgtcatctgcatcagcagatccgacggcagcacctactatgccgacagcgtgaagggacgcttcaccatctccagagacaatgccaaaaagacggtctacctgcaaatgatctccctcaagcctgaggataccgccgcctactattgtgccgctggcgctgattgcagcggctacctgagagactacgagttcagaggccagggcacacaagtgaccgtcagctctgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1885 - DNA, 3441 bp, Artificial Sequence
  Synthetic Polynucleotide encoding a CAR with optional accessory module(s)
atggccttaccagtgaccgccttgctcctgccgctggccttgctgctccacgccgccaggccggaggtgcaactggttgagtctggcggaggactggttcaggcaggcggatctctgagactgagctgtatcgccaccggcaaggtgttcagcatctacgacatgggctggtacagacaggcccctggcaagcagagagagctggttgccgagatcacaagcagcggcaccacacactacgacgacttcgtgtccggcagattcaccatcagccgggacaacgccaagaacaccgtgtacctccagatgaacaccctgaaggccgaggacaccgccgtgtactactgtagagccaaccacgtgttcggcggcagctattggggacagggaacccaagtgacagtgtctagtgaggtggccgctttggagaaacaggtgcagcttgttgaaagcggaggtggcctggttcaacctggcggaagcctgagactgtcctgtgaagccagcggctttaccctggactactacgccatcggctggtttagacaagctcccggcaaagagagagagggcgtcatctgcatcagcagatccgacggcagcacctactatgccgacagcgtgaagggacgcttcaccatctccagagacaatgccaaaaagacggtctacctgcaaatgatctccctcaagcctgaggataccgccgcctactattgtgccgctggcgctgattgcagcggctacctgagagactacgagttcagaggccagggcacacaagtgaccgtcagctctgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1886 - DNA, 3090 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggcagactggtgcagcctagaggaagcctgagactgtcttgtgccggcagcggcagaacctttagcacatacggcatggcctggttcagacaggcccctggaaaagagagagagttcgtcgccagcaaggccagcatgaactactccggcaggacctactacgccgacagcgtgaagggcagattcacaatcgccagagacaacgccaagaacatggtgttcctccagatgaacaatctgaagcccgaggacaccgccgtgtactattgtgccgctggcacaggctgtagcacctacggctgtttcgacgcccagatcatcgactactggggcaagggcacactggtcacagtttctagcgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1887 - DNA, 3063 bp, Artificial Sequence
  Synthetic Polynucleotide encoding a CAR with optional accessory module(s)
atggccttaccagtgaccgccttgctcctgccgctggccttgctgctccacgccgccaggccgcaagtcaaactggaagaaagcggtggcggcctggtgcaacctggcgaatctctgagactgagctgtagcgccagcggctccatcttcaaggtgttcagagtgttcgccatgagctggtacaggcaaggccctggcaagcagagagagctggtcgcctctatcagcagcggcgagacaaccacatacgccgactctgtgaaaggccggttcaccatcagccgggataatgccaagaataccgcctatctccagatggactccctgaagcctgaagatacagctgtgtactactgcaacgccgaccataccttcaccggcgatttttggggccagggaacccaagtgaccgtgtctagtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1888 - DNA, 3468 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggcagactggtgcagcctagaggaagcctgagactgtcttgtgccggcagcggcagaacctttagcacatacggcatggcctggttcagacaggcccctggaaaagagagagagttcgtcgccagcaaggccagcatgaactactccggcaggacctactacgccgacagcgtgaagggcagattcacaatcgccagagacaacgccaagaacatggtgttcctccagatgaacaatctgaagcccgaggacaccgccgtgtactattgtgccgctggcacaggctgtagcacctacggctgtttcgacgcccagatcatcgactactggggcaagggcacactggtcacagtttctagcgaggtggccgctttggagaaacaagtcaaactggaagaaagcggtggcggcctggtgcaacctggcgaatctctgagactgagctgtagcgccagcggctccatcttcaaggtgttcagagtgttcgccatgagctggtacaggcaaggccctggcaagcagagagagctggtcgcctctatcagcagcggcgagacaaccacatacgccgactctgtgaaaggccggttcaccatcagccgggataatgccaagaataccgcctatctccagatggactccctgaagcctgaagatacagctgtgtactactgcaacgccgaccataccttcaccggcgatttttggggccagggaacccaagtgaccgtgtctagtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1889 - DNA, 3057 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggagagctggttcaacctggcggacctctgagactgtcttgtgccgccagcggcaacatcttcagcatcaaccggatgggctggtacagacaggcccctggaaaacagagagccttcgtcgcctctatcaccgtgcggggcatcaccaattacgccgactctgtgaagggcagattcaccatcagcgtggacaagagcaagaacaccatctacctccagatgaacgccctgaagcctgaggacaccgccgtgtactactgcaatgccgtgtccagcaacagggaccccgattattggggccagggcacccaagtgacagtgtctagtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1890 - DNA, 3093 bp, Artificial Sequence
  Synthetic Polynucleotide encoding a CAR with optional accessory module(s)
atggccttaccagtgaccgccttgctcctgccgctggccttgctgctccacgccgccaggccgcctgttcaactggttgaatctggcggcggactggtgcaggctggcgatagtctcagactgagctgtgccgcctccggcagaacatttggcatcggcacaatgggatggttccggcagcctcctggaaaagaacgcgaatttgtggccgccatcagatggtctacaggcggcaccagatacgccgacagcgtgaaaggccggtttaccatcagcagagacaacgccaagctgaccgtggatctccagatggatagcctgaaaccagaggatacagccgtctattactgcgccgctgacaggctgagcctggatctgtctggcagataccactacaaccctgccgtgtacgactactggggacagggaacacaagtcaccgtgtcctctgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1891 - DNA, 3489 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggagagctggttcaacctggcggacctctgagactgtcttgtgccgccagcggcaacatcttcagcatcaaccggatgggctggtacagacaggcccctggaaaacagagagccttcgtcgcctctatcaccgtgcggggcatcaccaattacgccgactctgtgaagggcagattcaccatcagcgtggacaagagcaagaacaccatctacctccagatgaacgccctgaagcctgaggacaccgccgtgtactactgcaatgccgtgtccagcaacagggaccccgattattggggccagggcacccaagtgacagtgtctagtggaggcggtggaagtggcggcggtggttcaggcggcggaggatctcctgttcaactggttgaatctggcggcggactggtgcaggctggcgatagtctcagactgagctgtgccgcctccggcagaacatttggcatcggcacaatgggatggttccggcagcctcctggaaaagaacgcgaatttgtggccgccatcagatggtctacaggcggcaccagatacgccgacagcgtgaaaggccggtttaccatcagcagagacaacgccaagctgaccgtggatctccagatggatagcctgaaaccagaggatacagccgtctattactgcgccgctgacaggctgagcctggatctgtctggcagataccactacaaccctgccgtgtacgactactggggacagggaacacaagtcaccgtgtcctctgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1892 - DNA, 3063 bp, Artificial Sequence
  Synthetic Polynucleotide encoding a CAR with optional accessory module(s)
atggccttaccagtgaccgccttgctcctgccgctggccttgctgctccacgccgccaggccggccgtgcaactggttgaatctggcggaggactggtgcaggctggcgattctctgagactgacctgtacagccagcggcagagccttcagcacctacttcatggcctggttcagacaggcccctggcaaagagagagagttcgtcgccggaatcgcttggagcggaggctctacagcctacgccgattctgtgaagggcagattcaccatcagccgggacaacgccaagaacaccgtgtacctccagatgaacagcctgaagtccgaggacaccgccgtgtactactgtgccagcagaggcatcgaggtggaagagtttggagcctggggccagggaacccaagtgacagtttcttctgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1893 - DNA, 3066 bp, Artificial Sequence
  Synthetic Polynucleotide encoding a CAR with optional accessory module(s)
atggccttaccagtgaccgccttgctcctgccgctggccttgctgctccacgccgccaggccgcaggttcaactggtggaaagtggcggtggcttggtgcaagcaggcggctctcttagactgtcttgtgctgcctctggcggcaccctgagcaagaataccgtggcatggtttaggcaggctcccggaaaagagcggggctttgtcgccagcatcacctgggatggcagaaccacctactacgccgacagcgtgaaaggccggttcaccatctccagagataatgccaagaatacggtctacttgcaaatgaactccctgaagcctgaagatacagccgtgtacgtgtgcgccgatctcggcaaatggcctgctggacctgccgattattggggacagggcacacaagtcaccgtgtcctctgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1894 - DNA, 3444 bp, Artificial Sequence
  Synthetic Polynucleotide encoding a CAR with optional accessory module(s)
atggccttaccagtgaccgccttgctcctgccgctggccttgctgctccacgccgccaggccggccgtgcaactggttgaatctggcggaggactggtgcaggctggcgattctctgagactgacctgtacagccagcggcagagccttcagcacctacttcatggcctggttcagacaggcccctggcaaagagagagagttcgtcgccggaatcgcttggagcggaggctctacagcctacgccgattctgtgaagggcagattcaccatcagccgggacaacgccaagaacaccgtgtacctccagatgaacagcctgaagtccgaggacaccgccgtgtactactgtgccagcagaggcatcgaggtggaagagtttggagcctggggccagggaacccaagtgacagtttcttctcctggcggaggcgggtctcctcaggttcaactggtggaaagtggcggtggcttggtgcaagcaggcggctctcttagactgtcttgtgctgcctctggcggcaccctgagcaagaataccgtggcatggtttaggcaggctcccggaaaagagcggggctttgtcgccagcatcacctgggatggcagaaccacctactacgccgacagcgtgaaaggccggttcaccatctccagagataatgccaagaatacggtctacttgcaaatgaactccctgaagcctgaagatacagccgtgtacgtgtgcgccgatctcggcaaatggcctgctggacctgccgattattggggacagggcacacaagtcaccgtgtcctctgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1895 - DNA, 3528 bp, Artificial Sequence
  Synthetic Polynucleotide encoding a CAR with optional accessory module(s)
atggccttaccagtgaccgccttgctcctgccgctggccttgctgctccacgccgccaggccggccgtgcaactggttgaatctggcggaggactggtgcaggctggcgattctctgagactgacctgtacagccagcggcagagccttcagcacctacttcatggcctggttcagacaggcccctggcaaagagagagagttcgtcgccggaatcgcttggagcggaggctctacagcctacgccgattctgtgaagggcagattcaccatcagccgggacaacgccaagaacaccgtgtacctccagatgaacagcctgaagtccgaggacaccgccgtgtactactgtgccagcagaggcatcgaggtggaagagtttggagcctggggccagggaacccaagtgacagtttcttctcctggcggaggcgggtctcctcaggttcaactggtggaaagtggcggtggcttggtgcaagcaggcggctctcttagactgtcttgtgctgcctctggcggcaccctgagcaagaataccgtggcatggtttaggcaggctcccggaaaagagcggggctttgtcgccagcatcacctgggatggcagaaccacctactacgccgacagcgtgaaaggccggttcaccatctccagagataatgccaagaatacggtctacttgcaaatgaactccctgaagcctgaagatacagccgtgtacgtgtgcgccgatctcggcaaatggcctgctggacctgccgattattggggacagggcacacaagtcaccgtgtcctctgaggttgccgcactggagaaggaagtagccgcgcttgagaaagaggtggcagcgctggagaaagaagttgccgccttggaaaaagagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1896 - DNA, 3450 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagcgccagcagcagcgtgtcctacatgtactggtatcagcagaagcccggacaggcccctagactgctgatctacagaaccagcaacctggcctctggcatccccgccagattttctggctctggcagcggcaccgatttcaccctgaccataagcagcctggaacctgaggacttcgccgtgtactactgccagcagtaccacagctaccccaccacctttggacagggcaccaaggtggaaatcaagcggacagttggcggaggcggaagtggaggcggaggatctggcggcggaggctctgaagtgcagctggttgaatcaggtggcggcctggttcaacctggcggatctctgagactgtcttgtgccgccagcggcttcagcttcaacacctacgccatgaactgggtccgacaggctcctggcaaaggactggaatgggtgtcccacatcagaagcaagagcaacaacttcgccacctactacgccgacagcgtgaaggacagattcaccatcagccgggacaacgccaagaacagcctgtacctccagatgaactccctgagagccgaggacaccgccgtgtattattgcgccagacaaggcggcgacttccctatggattattggggccagggcaccctggtcaccgtttcttctacgcgtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1897 - DNA, 3432 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaaggcggaggcggaagtggaggcggaggatctggcggcggaggctctcaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1898 - DNA, 3447 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagaggcggaggcggaagtggaggcggaggatctggcggcggaggctctgaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1899 - DNA, 3441 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagaggcggaggcggaagtggaggcggaggatctggcggcggaggctctgaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1900 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcacgcgtagacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1901 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactacaacagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1902 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactaccaaagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1903 - DNA, 3405 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1904 - DNA, 3426 bp, Artificial Sequence
  Synthetic Polynucleotide encoding a CAR with optional accessory module(s)
atggccctgcctgtgacagctctgctgctgcctctggcactgctgctgcacgccgccagacctgacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaagggaggcggaggaagtggcggcggaggatctgggggaggcggaagccaggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1905 - DNA, 3423 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccaggccgctcccagcatccctgtgacacctggcgagagcgtgtccatctcctgccggtctagcaagagcctgctgaacagcaacggcaatacctacctgtactggttcctccagcggccaggccagtctccccaactgctgatctaccggatgagcaacctggcctccggcgtgcccgatagattttctggcagcggctccggcaccgccttcaccctgagaatcagcagagtggaagccgaggacgtgggcgtgtactactgtatgcagcacctggaataccccttcaccttcggagccggcaccaagctggaactgaagagaggcggaggcggaagtggaggcggaggatctggcggcggaggctctgaagtgcaactccagcagagcggccctgagctgattaagcctggggccagcgtgaagatgagctgcaaggccagcggctacaccttcaccagctacgtgatgcactgggtcaagcagaagcccggccagggcctggaatggatcggctacatcaacccctacaacgatggcaccaagtacaacgagaagttcaagggcaaggccaccctgaccagcgacaagagcagcagcaccgcctacatggaactgagcagcctgacaagcgaggacagcgccgtgtactattgcgccagaggcacctactactacggcagccgggtgttcgactattggggccagggcaccacactgaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1906 - DNA, 3417 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccccgatttccagagcgtgacccctaaagaaaaagtgaccatcacctgtcgggccagcgagagcgtggacacattcggcatcagcttcatgaactggttccagcagaagcccgatcagagccccaagctgctgattcacgccgccagcaatcaaggcagcggagtgcctagcagattttccggctctggcagcggcaccgatttcaccctgaccatcaatagcctggaagccgaggatgccgccacctactactgccagcagagcaaagaggtgcccttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcagctcttggatgaactgggtccgacaggcccctggcaaaggactggaatgggtcggaagaatctaccccggcgacggcgacaccaactacaacggcaagttcaagggcagattcaccatcagccgggacgacagcaagaacagcctgtacctgcagatgaactccctgaaaaccgaggacaccgccgtgtactactgtgccagatccggcttcatcaccaccgtgctggacttcgattattggggccagggcaccctggtcaccgtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1907 - DNA, 3405 bp, Artificial Sequence
  Synthetic Polynucleotide encoding a CAR with optional accessory module(s)
atggccttaccagtgaccgccttgctcctgccgctggccttgctgctccacgccgccaggccggccattcagctcacacagagcccttctagcctgagcgcctctgtgggcgacagagtgaccatcacatgtagagccagccagggcatcagcagcgcccagcagaaacctggaaaggcccctaagctgctgatcctggcctggtacagcagcctggaaagcggagtgcctagcagattcagcggctacgatgcctctggcagcggcaccgatttcaccctgacaatatccagcctccagcctgaggacttcgccacctactactgccagcagttcaacagctacccctacaccttcggccagggcaccaagctggaaatcaaaggcggaggcggaagtggaggcggaggatctggcggcggaggctctgaagtgcaactggttcagagcggagccgaagtgaagaagcctggcgagagcctgaagattagctgcaaaggctccggctacagcttcagcagctcttggatcggctgggtccgacagatgcctggcaaaggactggaatggatgggcatcatctaccccgacgacagcgacaccagatacagccctagcttccagggccaagtgacaatcagcgccgacaagagcatcagaaccgcctacctccagtggtcctctctgaaggccagcgataccgccatgtactactgcgccagacacgtgaccatgatctggggagtgattatcgacttctggggccagggaaccctggtcacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1908 - DNA, 3477 bp, Artificial Sequence
  Synthetic Polynucleotide encoding a CAR with optional accessory module(s)
atggccttaccagtgaccgccttgctcctgccgctggccttgctgctccacgccgccaggccgatcaacatctacaacgccgagcctgccaatcctagcgagaagaacagccccgaattcgacatcgtgatgacacagagccccgccacactgtcactgtctccaggcgaaagagccacactgagctgtcggagcagcaagagcctccagaacgtgaacggcaacacctacctgtactggttccagcagaagcccggccagtctcctcagctcctgatctacagaatgagcaacctgaacagcggcgtgcccgacagattttctggcagcggaagcggcaccgagttcaccctgaccataagcagcctggaacctgaggacttcgccgtgtactactgtatgcagcacctggaataccccatcaccttcggagccggcaccaagctggaaatcaaaggcggaggcggaagtggaggcggaggatctggcggcggaggctctgaagtgcaactggttgaatctggcggcggactggttaagcctggcggatctctgaagctgagctgtgccgccagcggctacacctttaccagctacgtgatgcactgggtccgacaggcccctggcaaaggacttgagtggatcggctacatcaacccctacaacgatggcaccaagtacaacgagaagttccagggcagagtgaccatcagctccgacaagagcatcagcaccgcctacatggaactgagcagcctgagaagcgaggataccgccatgtactattgcgccagaggcacctactactacggcaccagagtgttcgactactggggccagggaaccctggtcacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1909 - DNA, 3423 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacacagtctcccgccacactgtcactgtctccaggcgaaagagccacactgagctgtagagccagccagagcgtggactacgacggcgacagctacctgaactggtatcagcagaagcccggccagcctcctaagctgctgatctacgatgccagcaacctggtgtctggcatccctcctagattttccggcagcggctctggcaccgatttcaccctgaccatcagcagactggaacccgaggacttcgccgtgtaccactgtcagcagagcacagaggacccctggacatttggcggaggcaccaagctggaaatcaaaggcggaggcggaagtggaggcggaggatctggcggcggaggctctcaggtgcagctggttgaatctggcggcggacttgttgagcctggcggatctctgagactgagctgcatgagcggctacgccttcagcagctactggatgaactgggtccgacagatgcccggcaaaggactggaatggatgggccagatttggcctggcgacggcgataccaactacaaccccagcctgaagtccagagtgaccatcaccgccgatgagagcaccagcaccgcctacatggaactgtctagcctgaaggccgaggatacagccgtgtacttctgcgccagacgggaaaccacaaccgtgggcagatattactacgctatggactactggggccagggcaccctggttacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1910 - DNA, 3414 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacacagtctcccgccacactgtcactgtctccaggcgaaagagccacactgagctgtagagccagccagagcgtggacaactacggcatcagcttcatgaactggtatcagcagaagcccggccagcctcctaagctgctgatctacgccgccagcaatcaaggctctggcatccccagcagattttccggctctggaagcggcaccgacttcaccctgaccataagcagcctggaacctgaggacttcgccatgtacttttgccagcagagcaacgaggtgcccagaacctttggcggaggcaccaagctggaaatcaaaggcggaggcggaagtggaggcggaggatctggcggcggaggctctcaggtgcaactggttgagtctggcggcggacttgttgaacctggcggaagcctgagactgagctgcatgagcggctacgcctttagcagctcctggatgaactgggtccgacagatgcctggcaaaggactggaatggatgggcagaatctaccccggcgacggcgacaccaactacaacggcaagttcaaagaacgggtcaccatcaccgccgacgagagcacaagcaccgcctacatggaactgagcagcctgaaggccgaggataccgccgtgtacttctgcgccagaagcgagtattggggcaactactgggctatggactactggggccagggcacactggtcacagtgtctagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1911 - DNA, 3411 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacacagtctcccgccacactgtcactgtctccaggcgaaagagccacactgagctgcaaggccagtcagaacgtgggcacaaacgtggcctggtatcagcagaagcctggacagcctcctaagctgctgatctacagcgccacctaccggaactctggcatccctgccagattttctggcagcggctctggcaccgagttcaccctgaccatcaccaacgtgcagagcaaggacctggccgactacttctacttctgccagtacaacagatacccctacaccagcggcggaggcaccaagctggaaatcaaaagaggcggaggcggaagtggaggcggaggatctggcggcggaggctctcaggtgcaactggttgaatcaggcggaggactggtggaacctggcggatctctgagactgagctgtatgagcggctacgccttcagcagctactggatgaactgggtccgacagatgcccggcaaaggactggaatggatgggccaaatctaccccggcgacggcgacaccaactacaacggcaagttcaagggcagagtgacaatcaccgccgacgagagcacaagcaccgcctacatggaactgagcagcctgaaggccgaggataccgccgtgtacttctgcgccagaaagaccatcagcagcgtggtggatttctacttcgacaactggggccagggcaccctggtcacagtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1912 - DNA, 3450 bp, Artificial Sequence
  Synthetic Polynucleotide encoding a CAR with optional accessory module(s)
atggccttaccagtgaccgccttgctcctgccgctggccttgctgctccacgccgccaggccgatcaacatctacaacgccgagcctgccaatcctagcgagaagaacagccccgaattccagatcgtgctgacacagtctccagccacactgagcgcttctccaggcgagaaggccaccatgacatgttctgccagcagcggcgtgaactacatgcactggtatcagcagaagcccggcacaagccccaagcggtggatctacgataccgacaagacagccagcggagtgcccgccagattttctggctctggcagcggcacatcctacagcctgacaatcagcagcatggaagccgaggatgccgccacctactactgtcaccagagaggcagctacaccttcggcggaggcaccaagctggaaatcaaaggcggaggcggaagtggaggcggaggatctggcggcggaggctctcaagttcagctggaacaacctggcgctgaggtggtcaaaccaggggcctctgtgaaggtgtcctgcaagacaagcggctacacattcaccagcaactggatgcactgggtcaagcagacccctggcaaaggactggaatggatcggcgagatcgaccccagcgactcctacaccaactacaaccagaagttcgacggcaaggccaagctgaccgtggacaagtctagcagcaccgcctacatggaagtgtccgatctgaccgccgaagatagcgccacatattactgcgccagaggcagcaacccctactactacgctatggactattggggccagggcaccagcgtgacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1913 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1914 - DNA, 3432 bp, Artificial Sequence
  Synthetic Polynucleotide encoding a CAR with optional accessory module(s)
atggccttaccagtgaccgccttgctcctgccgctggccttgctgctccacgccgccaggccggacgacatccagctgacccagagccccagcagcctgagcgccagcgtgggcgacagagtgaccatcacctgcaaggccagccagagcgtggactacgacggcgacagctacctgaactggtaccagcagatccccggcaaggcccccaagctgctgatctacgacgccagcaacctggtgagcggcatcccccccagattcagcggcagcggcagcggcaccgactacaccttcaccatcagcagcctgcagcccgaggacatcgccacctaccactgccagcagagcaccgaggacccctggaccttcggcggcggcaccaagctgcagatcaagagaggcggaggcggaagtggaggcggaggatctggcggcggaggctctcaggtgcagctgcagcagagcggcgccgaggtgaagaagcccggcagcagcgtgaaggtgagctgcaaggccagcggctacgccttcagcagctactggatgaactgggtgagacagagacccggccagggcctggagtggatcggccagatttggcccggcgacggcgacaccaactacaacggcaagttcaagggcagagccaccatcaccgccgacgagagcaccaacaccgcctacatggagctgagcagcctgagaagcgaggacaccgccttctacagctgcgccagaagagagaccaccaccgtgggcagatactactacgctatggactactggggccagggcaccaccgtgaccgtgagcagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1915 - DNA, 3405 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctgcctctgtgtctggctctcctggccagagcatcaccatcagctgtaccggcaccagctctgatgtcggcggctacaattacgtgtcctggtatcagcagcaccccggcaaggcccctaagctgatgatctacgacgtgaacaacagacccagcgaggtgtccaacagattcagcggcagcaagagcggcaataccgccagcctgacaatctctggactgcaagccgaggacgaggccgactactactgtagcagctacaccacaggcagcagagccgtttttggcggaggcaccaaactgacagtgcttggaggcggaggcggaagtggaggcggaggatctggcggcggaggctctgaagttcagctggttcagtctggcgccgaagtgaagaagcctggcgagtctctgaccatctcctgcaaggccagcggctacagcttccccaactactggatcacctgggtccgacagatgtccggtggtggccttgagtggatgggcagaatcgatcccggcgactcctacaccacctacaatcctagcttccagggccacgtgaccatcagcatcgacaagagcaccaacaccgcctacctgcactggaacagcctgaaagccagcgacaccgccatgtactactgcgcccggtactatgtgtccctggtggacatttggggccagggcacactggtcacagtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1916 - DNA, 3423 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggtcacacagcctccatccgtgtctgctgcccctggacagaaagtgaccatctcctgtagcggcagcagcagcaacatcggcaacaactacgtgtcctggtatcagcagctccccggcacagctcccaaactgctgatctacgacaacaacaagcggcccagcggcatccccgatagattttctggcagcaagagcggcaccagcgccacactgggaattaccggacttcagacaggcgacgaggccgactactactgtggcacatgggatggcagcctgtacaccatgcttttcggcggaggcaccaagctgacagtgcttggcggaggcggaagtggaggcggaggatctggcggcggaggctctgaagtgcaactggtggaatctggcggcggactggttaagcctggcggatctctgagactgtcttgtgccgccagcggcttcaccttcagcaatgcctggatgagctgggttcgacaggcccctggaaaaggactggaatgggtcggattcatccggtccaaagcctacggcggcaccacagaatatgccgcctctgtgaagggcagattcaccatcagccgggacgacagcaagtctatcgcctacctccagatgaacaacctgaaaaccgaggacaccgccgtgtactactgcgccagagatggcctgtacagcagctcttggtacgacagcgattactggggccagggcacactggtcacagtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1917 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctcctagtgtgtctggcgctcctggacagagagtgaccatctcttgtaccggcagcagcagcaatatcggagccggctatgacgtgcactggtatcagcagctccctggcacagcccctaaactgctgatcttcggcaacagcaacagacccagcggcgtgcccgatagattcagcggctttaagagcggcacaagcgccagcctggctatcactggactgcaagccgaggacgaggccgactacttctgccagagctacgatagcagcctgagcggcagcggagtgtttggcacaggcaccaaagtgacagtgcttggcggcggaggcggaagtggaggcggaggatctggcggcggaggctctcaaatgcaactggttcaaagcggcggtggcctggtgcaacctggaagaagtctgagactgagctgtgccgccagcggcttcaccttcgatgattacgccatgcactgggtccgacaggcccctggaaaaggactggaatgggtgtccggcatctcctggaatagcggctctatcggctacgccgacagcgtgaagggcagattcaccatcagccgggacaacgccaagaacagcctgtacctccagatgaactccctgagagccgaggatacagccctgtactactgcgccaaggacatccacagcggcagctactacggcctgctgtactacgctatggacgtgtggggccagggcacaaccgtgacagtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1918 - DNA, 3399 bp, Artificial Sequence
  Synthetic Polynucleotide encoding a CAR with optional accessory module(s)
atggccttaccagtgaccgccttgctcctgccgctggccttgctgctccacgccgccaggccggactacatccacgtgacacagagccctagcagcctgtccgtgtccatcggcgatagagtgaccatcaactgccagacctctcaaggcgtgggcagcgacctgcactggtatcagcacaaacctggcagagcccctaagctgctgatccaccatgccagctctgtggaagatggcgtgcccagcagattttccggcaccggatttcacaccagcttcaacctgacaatcaacgacctccaggccgacgacatcggcacctactactgtcaagtgctccagagcttcggcagaggcagcagactggatacaaaaggcggaggcggaagtggaggcggaggatctggcggcggaggctctagggcacacctggtgcagtctggcaccgccatgaagaaacctggcgcttccgtcagagtgtcctgtcagacaagcggctacaccttcacagcccacatcctgttctggttcagacaggccccaggcagaggactggaatgggtcggatggatcaagccccagtacggggccgtgaatttcggcggaggcttcagagacagagtgaccctgaccagggacgtgtaccgggaaatcgcctacatggacatccggggcctgaagcctgatgacaccgccgtgtactactgcgccagggatagaagctacggcgacagctcttgggctctcgatgcttggggacagggcacaacagtggtggtgtctgctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1919 - DNA, 3429 bp, Artificial Sequence
  Synthetic Polynucleotide encoding a CAR with optional accessory module(s)
atggccttaccagtgaccgccttgctcctgccgctggccttgctgctccacgccgccaggccggacgtgcagatgatccagacccccgatagcctggccgtgtccctgggacagagagccaccatctcttgcagagccagcgagagcgtggacaactacggcatcagcttcatgcactggtatcagcagaagcccggccagagccccaagctgctgatctacagagcctccaacctggaaagcggcatccccgccagattttccggcagcggcagcagaaccgacttcaccctgaccatcaaccccgtggaaaccgacgacgtggcaacctactactgccagcagaacaacaaggacccccccacctttggcggaggcaccaagctggaaatcaagggcggaggcggaagtggaggcggaggatctggcggcggaggctctgggggaggcggctctcaggtgcaactccagcagtctggcgctgagcttgtgaagcctggggccagcgtgaagattagctgcaaggccagcggctacgccttcagcagctactggatgaactgggtcaagcagcggcctggcaagggcctggaatggatcggccaaatctaccccggcgacggcgacaccacctacaacggcaagttcaagggcaaggccaccctgacagccgacaagagcagcagcaccgtgtacatgcaactgaacagcctgaccagcgaggacagcgccgtgtacttctgcgtgcggtactactacggcagctccggctacttcgactattggggccagggcaccacactgaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1920 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggacgtgcagatgatccagacccccagcagcctgtctgccagcctgggcgatagagtgaccatcagctgtcgggccagccaggacatcggcaactacctgaactggtatcagcagaaacccgacggcaccgtgaagctgctgatctactacaccagcagactgcacagcggcgtgcccagcagattttctggcagcggctctggcaccgagtacagcctgaccatctccaacctggaacaggaagatattgctacctacttctgtcagcaaggcagcgccctgccccctacatttggcggcggaacaaagctggaaatcaacggcggaggcggaagtggaggcggaggatctggcggcggaggctctgctctccagctccagcagtctggcgcagaactcgtgcggcctggcgcttctgtgaccctgagctgtaaagccagcggctacaccttcaccgactacgagatgcactgggtcaagcagacccctgtgcacggcctggaatggatcggagccatcgaccctgagacaggcggcaccgcctacaaccagaagttcgagggcaaggccatcctgaccgccgacaagagcagcagcacagcctacatggaactgcggagcctgacctccgaggacagccccgtgtactactgtgccagacggcggtactacggcagcagctccttcgactattggggccagggcaccaccctgaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1921 - DNA, 3423 bp, Artificial Sequence
  Synthetic Polynucleotide encoding a CAR with optional accessory module(s)
atgaggctccctgctcagctcctggggctgctaatgctctgggtctctggaagcagtggggatgttgtgatgactcagtctccactctccctgcccgtcacccctggagcgccggcctccatctcctgcagatccagtcagagcattgtacatagtaatggaaacacctatttagagtggtatcttcaaaagccagggcagtctccaaagctcctgatctataaagtttccaaccgattttctggagtccctgacaggttcagtggaagtggatcaggcacagattttacactgagaatcagcagagtggaggctgaggatgttggaatttattactgctttcaaggttcacatgttcctccgacgttcggccctgggaccaaattggaaatcaaaggcggaggcggaagtggaggcggaggatctggcggcggaggctctgaagtgcagctggtggagtctgggggaggcttggtccagcctggggggtccctgagactctcctgttcagcctctggattcacctttagtagctttggaatgcactgggtccgccaggctccagggaaggggctggaatgggtggcctacattagtagtggcagtagtaccatctactatggagacaccgtgaagggccgattcaccatctccagagacaacgccaagaactcactgtttctgcaaatgagcagcctgagagccgaggacacggccgtgtattattgtgcgagagaggggggatattactacggaaggagttactatactatggactactggggccaagggaccacggtcaccgtctccacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1922 - DNA, 3498 bp, Artificial Sequence
  Synthetic Polynucleotide encoding a CAR with optional accessory module(s)
atggccttaccagtgaccgccttgctcctgccgctggccttgctgctccacgccgccaggccggccagaaagagaacccagcccaccttcggcttcaccgtgaactggaagttcagcgagagcaccaccgtgttcaccggccagtgcttcatcgaccggaacggcaaagaggtgctgaaaaccatgtggctgctgcggagcagcgtgaacgacatcggcgacgactggaaggccaccagagtgggcatcaacatcttcacccggctgcggacacagaaagagggcggctctggcggaagcgccagaaagtgtagcctgaccggcaagtggaccaacgacctgggcagcaacatgaccatcggagccgtgaacagcagaggcgagtttaccggcacctacatcaccgccgtgaccgccaccagcaacgagatcaaagagagccccctgcacggcacccagaacaccatcaacaagagcggcggcagcacaacagtgtttacaggacagtgctttattgaccgcaatgggaaagaagtgctgaaaacaatgtggctgctgaggtcctccgtgaatgacattggagatgattggaaagctacaagagtggggattaacatttttaccagactgaggacccagaaagaagggggcagcggaggctccgccagaaaatgctctctgacagggaagtggacaaatgatctggggtccaatatgacaatcggcgctgtgaactctcggggcgagttcactggaacatatattacagccgtgacagctacctctaacgaaatcaaagagtctcctctgcacgggacacagaataccattaacaaacggacccagcctacatttgggtttacagtgaattggaaattctccgagacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1923 - DNA, 3414 bp, Artificial Sequence
  Synthetic Polynucleotide encoding a CAR with optional accessory module(s)
atggccttaccagtgaccgccttgctcctgccgctggccttgctgctccacgccgccaggccggacatcgtcctgacccagtccccagccagcctggcggtgtccctgggtcaacgagctaccatttcctgcagagcctctaagtccgtatccacttccggctatagttacctgcattggtaccaacagaaaccagggcagccacccaagctgctcatctatctggcctcaaacctggagtccggcgtgcccgccagattctccggaagtgggagcggcaccgactttacattgaacatccacccagtcgaagaggaagatgctgccacttattactgtcagcactccagggagctgccatttacatttggctctggcacaaaactggagatcaaaggcggaggcggaagtggaggcggaggatctggcggcggaggctctcaggttcagctggtcgagtccgggggaggtctggtacagccgggtggcagcctcaagctgtcatgtgccgcatctggttttgactttagcaggtattggatgagctgggtccgccaggccccgggcaagggacttgagtggattggagaaataaaccctacttccagcacaatcaacttcacaccttctttgaaagataaggtttttatctctcgggataacgctaaaaacacactgtacttgcagatgtctaaggtgcgaagcgaagacaccgccctctattattgcgcccggggtaattactaccgctatggggatgcgatggactattgggggcaaggtacctccgtcacggtctcaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1924 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccctagctcactgagcgccagcgtgggcgacagggtgaccattacctgctccgccagccaggacatcagcaactacctgaactggtaccagcagaagcccggcaaggcccccaagctgctgatctactacacctccaacctgcactccggcgtgcccagcaggttcagcggaagcggcagcggcaccgatttcaccctgaccatctccagcctgcagcccgaggacttcgccacctactactgccagcagtacaggaagctcccctggactttcggccagggcaccaaactggagatcaagcgtggcggaggcggaagtggaggcggaggatctggcggcggaggctctcaggtgcagctggtccagagcggcgccgaagtgaagaagcccggcagctccgtgaaagtgagctgcaaggccagcggcggcaccttcagcaactactggatgcactgggtgaggcaggcccccggacagggcctggagtggatgggcgccacctacaggggccacagcgacacctactacaaccagaagttcaagggccgggtgaccatcaccgccgacaagagcaccagcaccgcctacatggaactgagcagcctcaggagcgaggacaccgctgtgtattactgcgccaggggcgccatctacgacggctacgacgtgctggacaactggggccagggcacactggtgaccgtgtccagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1925 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctcaggtgcagctggtgcagtctggccccgaagtgaagaaacccggcgagtccgtgaagatcagctgcaaggccagcggctacaccttccggcactacagcatgaactgggtcaagcaggccccaggccagggcctgaagtggatgggcagaatcaacaccgagagcggcgtgcccatctacgccgacgacttcaagggccggttcagcttcaccgtggacaccagcgccagcaccgcctacctggaaatctccagcctgaccagcgaggataccgccgtgtatttctgctccaacgactacctgtacagcctggatttctggggccagggaaccaccctgacagtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1926 - DNA, 3411 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctcctagtgtgtctggcgctcctggacagagagtgaccatcagctgtacaggcagcagcagcaatatcggagccggctttgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctacgttttcggcaccggcaccaaagtgacagtgcttggtggcggaggcggaagtggaggcggaggatctggcggcggaggctctcaagttcagctggttcagagcggagccgaagtgaagaaacctggggcctctgtgaaggtgtcctgcaaggcttccggctacacctttaccgattactacatgcactgggtccgacaggctcccggccaaagacttgaatggatgggctggatcaaccccaacagcggcggcacaaattacgcccagaagttccaggaccggatcaccgtgaccagagacaccagctccaacaccggctacatggaactgacccggctgagatccgatgacaccgccgtgtactactgcgctagaagcccttactccggcgtgctggataagtggggacagggcacactggtcaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1927 - DNA, 3405 bp, Artificial Sequence
  Synthetic Polynucleotide encoding a CAR with optional accessory module(s)
atggccttaccagtgaccgccttgctcctgccgctggccttgctgctccacgccgccaggccgcaggctgttctgacacagcctccatctgcctctggcacacctggacagagagtgaccatctcctgtagcggcagcagcagcaacatcggcagctacaccgtgtcctggtatcagcagctccctggaacagcccctaagttcctgatctacagcaacaaccagcggcctagcggcgtgcccgatagattttctggcagcaagagcggcacaagcgccagcctggctatttctggactccagtctgaggacgaggccgactactattgtgccgcctgggacgatagcctgaacggctatgtgtttggcaccggcaccaaagtgacagtgcttggtggcggaggcggaagtggaggcggaggatctggcggcggaggctctgaagttcaactggttcagagcggagccgaagtgaagaagcctggcgagagcctgaagattagctgcaaaggcagcggctacgacttcaccacctactggatcggctgggtccgacagatgcctggcaaaggactggaatggatgggcatcatctaccccggcgacagcgacaccagatacagccctagcgttagaggccgcgtgaccatcagcgccgacaagtctatcaacaccgcctacctccagtggtccagcctggaagcctctgacaccgccatgtactactgcgccagaatgtggaccttcagccaggatggatggggccagggaacactggtcacagtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1928 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccgctgcctgttctgacacagcctccatctgcctctggcacacctggacagagagtgaccatcagctgtagcggcagaagcagcaacatcggcagcaacagcgtgaactggtacagacagcttcctggcgctgcccctaagctgctgatctacagcaacaaccagcggcctcctggcgtgccagtcagattttctggcagcaagagcggcacaagcgccagcctggctatttctggactccagtctgaggacgaggccacctactactgtgccacctgggacgacaacctgaacgtgcactacgtgttcggcaccggcaccaaagtgacagtgcttggaagtagaggcggaggcggaagtggaggcggaggatctggcggcggaggctctcttgaaatggctcaggtgcagctggtgcagagcggagccgaagtgaagaaacctggcagcagcgtgaaggtgtcctgcaaagcttctggcggcaccttcagcagctacgccatctcttgggttcgacaggcccctggacaaggactggaatggatgggcagaatcatccccatcctgggaatcgccaactacgcccagaaattccagggcagagtgacaatcaccgccgacaagagcaccagcaccgcctacatggaactgagcagcctgagaagcgaggacaccgccgtgtactattgtgcaagaggcggctactacagccacgacatgtggagcgaagattggggccagggcacactggtcacagtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1929 - DNA, 3405 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1930 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaggcggaggcggaagtggaggcggaggatctggcggcggaggctctcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1931 - DNA, 3411 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgcaagagcagccagagcatcctgtacagcagcaaccagaagaactacctggcctggtatcagcagaagcccggccagagccctaagctgctgatctactgggccagcaccagagaaagcggcgtgcccgatagattcagcggcagcggctctggcaccgacttcaccctgaccatcagttctcttcaggccgaggacgtggccgtgtactactgccaccagtacatcagctcctacaccttcggccagggcaccaagctggaaatcaagggcggaggcggaagtggaggcggaggatctggcggcggaggctctcaggtgcagctggtgcagtctggcgctgaagtgaagaaacctggggccagcgtgaaggtgtcctgcaaggccagcggctacacctttgccagccagtggatgcactggatgagacaggcccctggacagggcctggaatggatcggctggatcaaccccggcaacgtgaacaccaagtacaacgagaagttcaagggcagagccaccctgacagtggacaccagcaccaacaccgcctacatggaactgagcagcctgcggagcgaggacaccgccgtgtattattgcgccagaagcacctggtacagacccctggattattggggccagggaacccttgtgaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1932 - DNA, 3783 bp, Artificial Sequence
  Synthetic Polynucleotide encoding a CAR with optional accessory module(s)
atggttaggggcgttccattcagacatctgcttctggtcttgcagcttgcactcttgcccgctgccacccagggcaaaaaagtggtgctgggcaagaaaggcgacaccgtggaactgacctgcaccgccagccagaagaagtccatccagttccactggaagaacagcaaccagatcaagatcctgggcaaccagggcagcttcctgaccaagggacccagcaagctgaacgacagagccgacagcagacggtccctgtgggaccagggcaatttcccactgattatcaagaacctgaagatcgaggacagcgacacctacatctgcgaggtggaagatcagaaagaagaggtgcaactgctggtgttcggcctgaccgccaactccgacacccatctgctccagggccagagcctgaccctgacactggaaagccctccaggcagctcccccagcgtgcagtgtagaagcccacgaggcaagaacatccagggaggcaaaacattgtcagtgtcccaactggaactccaggactccggcacctggacctgtaccgtgctccagaaccagaaaaaggtggagttcaagatcgacatcgtggtgctggccttccagaaagcctctggcggaggcggaagtggaggcggaggatctggcggcggaggctctatctaccaggaactgacacaactgaaggccgccgtggaacggctgtgccacccttgtccttgggagtggaccttctttcagggcaactgctacttcatgagcaacagccagcggaactggcacgacagcatcaccgcctgcaaagaagtgggagcccaactggtcgtgattaagagcgccgaggaacagaacttcctccaactccagagcagcagaagcaacagattcacctggatgggcctgagcgacctgaaccaggaaggcacctggcagtgggtggacggatctcctctgctgcccagcttcaagcagtattggaaccggggcgagcccaacaacgtgggcgaagaggattgcgccgagttcagcggcaacggctggaacgacgacaagtgcaacctggctaagttctggatctgcaagaagtccgccgcctcctgtagccgggatgaggaacagttcctgagccctgcccctgccacccctaatcctccaccagctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1933 - DNA, 3411 bp, Artificial Sequence
  Synthetic Polynucleotide encoding a CAR with optional accessory module(s)
atggccttaccagtgaccgccttgctcctgccgctggccttgctgctccacgccgccaggccggaccacatcgtgctgacccagagccctagcagcctgtctgccagcctgggcgacagagtgaccatcagctgtagagccagccaggacatcagcacctacctgaactggtatcagcagaaacccgacggcaccgtgaagctgctgatcttctacaccagcagactgcacgccggggtgcccagcagattttctggcagcggctctggcacccaccacagcctgaccatctccaacctggaacaggaagatattgctacctacttctgtcagcaaggcaacagcctgcccttcaccttcggcagcggcaccaagctggaaatcaagagaggcggaggcggaagtggaggcggaggatctggcggcggaggctctcaggtgcagctgaaagagagcggccctgagctggaaaagcctggggccagcgtgaagattagctgcaaggccagcggctacagcttcaccgcctacagcatgaactgggtcaagcagaacaacggcatgagcctggaatggatcggcagcatcgacccctactacggcgacaccaaatacgcccagaagttcaagggcaaggccaccctgaccgtggataaggccagcagcaccgcctacctccagctgaagtctctgaccagcgaggacagcgccgtgtactactgcgccagacggatgattaccaccggcgactggtacttcgacgtgtggggagccggaaccaccgtgacagtgtctagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1934 - DNA, 3411 bp, Artificial Sequence; identical to SEQ ID NO: 1933
  Synthetic Polynucleotide encoding a CAR with optional accessory module(s)

SEQ ID NO: 1935 - DNA, 3252 bp, Artificial Sequence
  Synthetic Polynucleotide encoding a CAR with optional accessory module(s)
atggcccttccagtcactgccttgctgttgcctctggcgctcctgctccacgccgctagaccgggcatgagaaccgaggacctgcctaaggccgtggtgttcctggaaccccagtggtacagagtgctggaaaaggacagcgtgaccctgaagtgccagggcgcctacagccccgaggacaatagcacccagtggttccacaacgagagcctgatctccagccaggccagcagctacttcatcgacgccgccaccgtggacgacagcggcgagtatagatgccagaccaacctgagcaccctgagcgaccccgtgcagctggaagtgcacatcggatggctgctgctgcaggcccccagatgggtgttcaaagaagaggaccccatccacctgagatgccactcttggaagaacaccgccctgcacaaagtgacctacctgcagaacggcaagggcagaaagtacttccaccacaacagcgacttctacatccccaaggccaccctgaaggactccggctcctacttctgcagaggcctcgtgggcagcaagaacgtgtccagcgagacagtgaacatcaccatcacccagggcctggccgtgtctaccatcagcagctttttcccacccggctaccagacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1936 - DNA, 3252 bp, Artificial Sequence
  Synthetic Polynucleotide encoding a CAR with optional accessory module(s)
atggccttaccagtgaccgccttgctcctgccgctggccttgctgctccacgccgccaggccgggcatgcggactgaagacctcccaaaggctgtggtgttcctggagcctcaatggtacagggtgctggagaaggacagtgtgactctgaagtgccagggagcctactcccctgaggacaattccacacagtggtttcacaatgagagcctcatctcaagccaggcctccagctacttcattgacgctgccacagtggacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggcttgttgggagtaaaaatgtgtcttcagagactgtgaacatcaccatcactcaaggtttggcagtgtcaaccatctcatcattctttccacctggctaccaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1937 - DNA, 3411 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaagtgcagctggtggaatcaggcggcggactggtgcagcctggcagaagcctgagactgagctgtgccgccagcggcttcaccttcaacgactacgccatgcactgggtgcgccaggcccctggaaaaggactggaatgggtgtccacaatcagctggaacagcggcagcatcggctacgccgatagcgtgaagggccggttcaccatcagccgggacaacgccaagaagtccctgtacctccagatgaacagcctgcgggccgaggacacagccctgtactattgcgccaaggacatccagtacggcaactactactacggcatggacgtgtggggccagggaaccaccgtgaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1938 - DNA, 3417 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacccccctgagcctgcctgtgacacctggcgagcctgccagcatctcctgcagaagcagcaagagcctgctgcacagcaacggcatcacctacctgtactggtatctgcagaaacccggccagagcccccaactgctgatctaccagatgagcaacctggtgtccggcgtgcccgacagattttctggcagcggctccggcaccgacttcaccctgaagatcagccgggtggaagccgaggacgtgggcgtgtactactgcgcccagaacctggaactgccctacacctttggcggcggaacaaaggtggaaatcaagcggggcggaggcggaagtggaggcggaggatctggcggcggaggctctcaggtgcaactggtgcagagcggagccgaagtgaaaaagcccggcagcagcgtgaaggtgtcctgcaaggccagcggctacgccttcagctactcctggatcaactgggtgcgccaggcccctggacagggcctggaatggatgggcagaatcttccccggcgacggcgacaccgactacaacggcaagttcaagggcagagtgaccatcaccgccgacaagagcaccagcaccgcctacatggaactgagcagcctgcggagcgaggataccgccgtgtactattgtgccagaaacgtgttcgacggctactggctggtgtactggggccagggaacacttgtgaccgtgtccagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1939 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccatcatcacagcctctccaggcgagaaagtgaccatgacctgtagagccagcagcagcgtgaactacatggactggtatcagaagaagcccggcagcagccccaagccttggatctacgccacaagcaatctggcctctggcgtgcccagcagattttctggctctggcagcggcaccacctacagcatgacaatctctagcctggaagccgaggacgccgccacctactattgtcagcagtggtccttcaatcctcctaccttcggcggaggcaccaagctggaaatcaaaagaggcggaggcggaagtggaggcggaggatctggcggcggaggctctgaagttcagcttcagcagagcggagccgagctgaagaaacctggcgcttctgtgaaggtgtcctgcaaggccagcggctacacctttaccagctacaacatgcactgggtcaagcagaccccaggccagggactcgaatggatcggagccatctatcccggcaacggcgacacctcctacaaccagaagttcaagggcaagaccacactgaccgccgacaagagcagctccaccgcctacatggaactgagcagcctgagatccgaggataccgccgtgtactactgcgccagaagcaactactacggcagctcctactggttcttcgacgtgtggggcaccggcacaaccgtgacagtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1940 - DNA, 3417 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcgactggcccctgacatttggcggcggaacaaaggtggaaatcaaaggcggaggcggaagtggaggcggaggatctggcggcggaggctctgaagtgcaactggttcaatcaggtggcggcctggttcaccctggcggatctctgagactgtcttgtaccggcagcggcttcaccttcagctaccacgccatgcactgggtccgacaggcacctggaaaaggactggaatgggtgtccatcatcggcacaggcggcgtgacctactacgccgattctgtgaagggcagattcaccatcagccgggacaacgtgaagaacagcctgtacctccagatgaactccctgagagccgaggatatggccgtgtattattgcgccagagactactacggcgctggcagcttttacgacggcctgtacggaatggatgtgtggggccagggaaccaccgtgactgtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1941 - DNA, 3411 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacatttggcggaggcaccaaggtggaaatcaaaggcggaggcggaagtggaggcggaggatctggcggcggaggctctgctgtgcagctcgttgagtctggcggaggacttgttcagcctggcagatccctgagactgtcttgtgccgccagcggcttcaccttcggcgattacacaatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactattgcaccaaggacaaccagtacggctccggcagcacatacggacttggagtttggggccagggcaccctggttacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1942 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagcctctgatctacgcccctagcaatctggcctctggcgtgccaagcagattttctggcagcggctctggcaccgacttcaccctgacaatatccagcctccagcctgaggacttcgccacctactactgccagcagtggtccttcaatcctcctaccttcggccagggcaccaaggtggaaatcaaaagaggcggaggcggaagtggaggcggaggatctggcggcggaggctctgaagtgcagcttgttgaatctggcggcggactggttcagcctggcggatctctgagactgtcttgtgccgccagcggctacaccttcaccagctacaatatgcactgggtccgacaggcccctggcaaaggacttgaatgggtcggagccatctatcccggcaacggcgacacctcctacaaccagaagttcaagggcagattcaccatcagcgtggacaagagcaagaacaccctgtacctccagatgaactccctgagagccgaggacaccgccgtgtactattgtgccagagtggtgtactacagcaacagctactggtacttcgacgtgtggggccagggaaccctggtcacagtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1943 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggacatccagctcacacagagcccttctagcctgtctgccagcgtgggcgatagagtgaccatgacctgtagagccagcagcagcgtgtcctacatccactggttccagcagaagcctggcaaggcccctaagccttggatctacgccaccagcaatctggcctctggcgtgccagtcagattttctggcagcggctctggcaccgactacaccttcacaatatccagcctccagcctgaggacattgccacctactactgccagcagtggacctccaatcctcctacctttggcggaggcaccaagctggaaatcaaaggcggaggcggaagtggaggcggaggatctggcggcggaggctctcaggttcagctccagcagtctggggccgaagtgaagaaacctggcagctccgtgaaagtgtcctgcaaggccagcggctacacctttaccagctacaacatgcactgggtcaagcaggcccctggacagggactcgaatggatcggagccatctatcccggcaacggcgacacctcctacaaccagaagttcaagggcaaagccacactgaccgccgacgagagcacaaacaccgcctacatggaactgagcagcctgagaagcgaggacaccgccttctactactgtgcccggtctacctactacggcggcgactggtactttgacgtgtggggccagggaaccaccgtgacagtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1944 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccgagcaccgtgatgacacagagccctgatagcctggccgtgtctctgggagagagagccaccatcaactgcaagagcagccagagcaacagcaacgacgtggcctggtatcagcagaagccaggacagagccccaaggtgctgatctacttcgccagcaacagatacagcggcgtgcccgatagattttccggcagcggctacggcaccgacttcacccttacaatcagcagcctccaggccgaggatgtggccgtgtacttctgtcagcaagactacagcagccctctgacctttggagccggcaccaagctggaactgaaaagagctgacgctggcggaggcggaagtggaggcggaggatctggcggcggaggctctcagattcagctggtgcagtctggcagcgagctgaagaaacctggggcctctgtgaaggtgtcctgcaaggcttccggctacacctttaccaacttcggcgtgaactgggtccgacaggcccctggaaaaggactggaatggatgggctggatcaacacctacaccggcgagcctagctacgcccagggctttacaggcagattcgtgttcagcctggacgcctctgtgtctaccgcctacctccagatcagctccctgaaagccgaggacaccgccacctatttctgcaccagacggaccaactactacgggacctcctactactacgctatggactactggggccagggcaccaccgtgacagtgtctagcgccaagacaaccacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1945 - DNA, 3414 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctggcggaggcggaagtggaggcggaggatctggcggcggaggctctcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1946 - DNA, 3408 bp, Artificial Sequence; identical to SEQ ID NO: 1942
  Synthetic Polynucleotide encoding a CAR with optional accessory module(s)

SEQ ID NO: 1947 - DNA, 3405 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagcccttctagcctgtctgccagcgtgggcgacagagtgaccatcacatgtagagccagcagcagcctgagcttcatgcactggtatcagcagaagcccggcaaggcccctaagccttggatctacgccaccagcaatctggcctctggcgtgccaagcagattttctggcagcggctctggcaccgactacaccctgacaatatccagcctccagcctgaggacttcgccacctacttttgccaccagtggtccagcaatcctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaggcttccggctacacctttaccagctacaatatgcactgggtccgacaggctcccggccagagacttgaatggatcggagccatctatcccggcaacggcgacacctcctacaaccagaaattcaagggccgcgtgaccgtgaccagagacacatctgccaacaccgcctacatggaactgtctagcctgaagtccgaggacaccgccgtgtactactgtgccagaagccactacggcagcaactacgtggactacttcgactactggggccagggcacactggtcacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1948 - DNA, 3411 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaggtgcagcttgttgagtctggcggaggactggtgcagcccgatagaagcctgagactgtcttgtgccgccagcggcttcaccttccacgattatgccatgcactgggtccgacaggcccctggcaaaggacttgaatgggtgtccaccatctcttggaacagcggcacaatcggctacgccgactctgtgaagggcagattcaccatcagccgggacaacgccaagaacagcctgtacctccagatgaactccctgagagccgaggacacagccctgtactactgcgccaaggacatccagtacggcaactactactacggcatggacgtgtggggccagggcacaacagtgacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1949 - DNA, 3405 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagccagcagcagcgtgccctacatccactggtatcagcagaagcctggacaggcccctcggctgctgatctatgccacatctgctctggcctctggcatccccgatagattttctggcagcggctccggcaccgacttcaccctgacaatcagcagactggaacccgaggacttcgccgtgtactactgtcagcagtggctgagcaaccctcctacattcggccagggcaccaagctggaactgaaaagaggcggaggcggaagtggaggcggaggatctggcggcggaggctctgaagttcagctggttcagagcggagccgaagtgaagaagccaggcgagagcctgaagctgagctgcaaaggcagcggcagaaccttcaccagctacaacatgcactgggtccgacagatgcccggcaaaggactggaatggatgggcgctatctaccctctgaccggcgacacctcctacaaccagaaaagcaagctgcaagtgaccatcagcgccgacaagagcatcagcacagcctacctccagtggtcctctctgaaggccagcgacaccgccatgtactattgtgccagaagcacctacgtcggcggcgactggcagtttgatgtgtggggcaagggcaccaccgtgaccgtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1950 - DNA, 3420 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtcggagcagccagagcatcgtgcactccgtgggcaacaccttcctggaatggtatcagcagaagcccggcaaggcccccaagctgctgatctacaaggtgtccaacagattcagcggcgtgcccagcaggtttagcggctctggcagcggcaccgacttcaccctgaccatctctagcctccagcccgaggacttcgccacctactactgttttcaaggcagccagttcccctacaccttcggccagggaacaaaggtggaaatcaagcggggcggaggcggaagtggaggcggaggatctggcggcggaggctctgaagtgcaactggtggaaagcggaggcggcctggtgcagcctggcggatctctgagactgagctgtgccgccagcggctacgagttcagccggtcctggatgaactgggtgcgccaggcccctggcaagggactggaatgggtgggaagaatctaccccggcgacggcgacaccaactacagcggcaagttcaagggccggttcaccatcagcgccgacaccagcaagaacaccgcctacctccagatgaacagcctgcgggccgaggataccgccgtgtactactgtgccagagatggcagctcctgggactggtacttcgacgtgtggggacagggaacccttgtgaccgtgtccagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1951 - DNA, 3396 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccagcagcctgtctgccagcgtgggcgacagagtgaccatcacatgcaaggccagccagagcgtgaccaacgacgtggcctggtatcagcagaagcccggcaaggcccccaagctgctgatctactacgccagcaacagatacaccggcgtgcccagcagattcagcggctctggcagcggcaccgacttcaccctgaccatctctagcctccagcccgaggacttcgccacctactactgtcagcaggactacagaagcccctggaccttcggcggaggcaccaaggtggaaatcaagcggggcggaggcggaagtggaggcggaggatctggcggcggaggctctcaggtgcaactggaagaaagcgggggaggcgtcgtgcggcctggaagaagtctgagactgagctgtgccgccagcggcttcaccttcagcgactacggcgtgaactggatcagacaggcccctggcaagggcctggaatgggtcacaatcatctggggcgacggcagaaccgactacaacagcgccctgaagtcccggttcaccgtgtcccggaacaacagcaacaacaccctgagcctccagatgaacagcctgaccaccgaggacaccgccgtgtactactgtgtgcgggctcccggcaaccgggctatggaatattggggacagggcgtactcgtgaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1952 - DNA, 3414 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagggcggaggcggaagtggaggcggaggatctggcggcggaggctctcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1953 - DNA, 3414 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcggcggaggcggaagtggaggcggaggatctggcggcggaggctctgacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1954 - DNA, 3393 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccgccaccatcgagaacacaagcctgtctgccagcgtgggcgacagagtgaccatcacctgtagagccagccagggcatcagctcttggctgacctggtatcagcagaagcccgagaaggcccccaagagcctgatctacgccgccagctctctgcagtctggcgtgcccagcagattttccggcagcggctctggcaccgacttcaccctgacaatcagcagcctgcagcccgaggacttcgccacctactactgccagcagtacgacagctaccccatcaccttcggccagggcacccggctggaaatcaagggcggaggcggaagtggaggcggaggatctggcggcggaggctctcaggtgcaactgcagcagtggggagccggactgctgaagcctagcgagacactgagcctgacctgcgccgtgtacggcggcagcttcagcgcctactattggagctggatcagacagccccctggcaagggcctggaatggatcggcgacatcaatcacggcggaggcaccaactacaaccccagcctgaagtcccgcgtgaccatctccgtggacaccagcaagaaccagttctccctgaagctgaacagcgtgacagccgccgacacagccgtgtactactgtgccagcctgaccgcctattggggccagggatctcttgtgaccgtgtccagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1955 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacccagagccctgatagcctggccgtgtctctgggcgagagagccaccatcaactgcaaggccagccagagcgtggacttcgacggcgacagctacctgaactggtatcagcagaagcccggccagccccccaaggtgctgatctatgccgccagcacactgcagagcggcgtgcccagcagattttctggcagcggctccggcaccgacttcaccctgaccatcaacagcctggaagccgaggacgccgccacctactactgccagcagagcaacgaggacccctggacctttggcggcggaacaaaggtggaaatcaagggcggaggcggaagtggaggcggaggatctggcggcggaggctctcaggtgcaactggtgcagtccggcgctgaagtgaagaaacctggggccagcgtgaaggtgtcctgcaaggtgtccggctacacctttaccgactactacattacctgggtgcgccaggcccctggacaggccctggaatggatgggctggatctaccccggcagcggcaacaccaagtacagccagaagttccagggcagattcgtgttcagcgtggacaccagcgccagcaccgcctacctgcaactgtctagcctgaaggccgaagataccgccgtgtactactgcgccaactacggcaactattggttcgcctattggggccagggaacccttgtgaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1956 - DNA, 3399 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtgcagtctggcggagggctggtgcatcctgggggaagcctgagactgagctgtgccggctctggcttcgccttcagcagcagcaccatgcactggatcagacaggcccctggcaagggcctggaatggatcagcctgatcggaagcggagggggcatctactacggcgacagcgtgaagggccggttcaccatcagccgggacaacgccaagaacagcctgtacctccagatgaactccctgcgggccgaggacatggccgtgtactattgtgtgcggggctacttcgactgggtggactacttcgattactggggccagggcaccctcgtgaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1957 - DNA, 3429 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgatgacacagtcaccagatagcctcaccgtctccctgggggagcggaccaccattaattgtaaatccagccaaagcgtgctggactcaagcaagaacaagaatagcctcgcctggtatcagcagaagcccggtcagcctccaaagctgctgctttcttgggcctccaccagagagtccgggattcctgataggtttagtggttcaggctccggcacagattttactctgaccattgattctctccagccagaggattctgcaacttattactgccagcaaagcgcccactttcctataacttttggccagggaacccgacttgaaatcaagggcggaggcggaagtggaggcggaggatctggcggcggaggctctcaggtgcagctggtgcagagcggtgccgaagtgaagaaaccaggtgcatccgttaaagtttcatgtaaggctagtggatataccttcaccaattacggaatgaactgggtgaaacaggcccctggccagggactgaagtggatggggtggattaacacctacaccggggagccgacttatgcagacgactttaaggggcgggtcacgatgacctccgacacctccaccagtaccgcctacctggagctgcacaaccttaggtcagacgataccgccgtgtattactgtgcccgatggtcttggtccgacggatactatgtctacttcgactattggggccaggggaccacagttaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1958 - DNA, 3417 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctggaagcctggccgtgtctcctggcgagcgcgtgacaatgagctgcaagagcagccagagcgtgttcttcagcagctcccagaagaactacctggcctggtatcagcagatccccggccagagccccagactgctgatctactgggccagcaccagagaaagcggcgtgcccgatagattcaccggcagcggctctggcaccgacttcaccctgacaatcagcagcgtgcagcccgaggacctggctatctactactgccaccagtacctgagcagccggaccttcggccagggcaccaagctggaaatcaagagaggcggaggcggaagtggaggcggaggatctggcggcggaggctctcaggtgcaactgcagcagcctggcgctgaggtcgtgaagccaggcgcttccgtgaagatgtcctgcaaggccagcggctacaccttcaccagctactacatccactggatcaagcagacccctggacagggcctggaatgggtgggagtgatctaccccggcaacgacgacatcagctacaaccagaagttccagggcaaggccaccctgaccgccgacaagtctagcaccaccgcctacatgcaactgtccagcctgaccagcgaggacagcgccgtgtactactgcgccagagaagtgcggctgcggtacttcgatgtgtggggccagggaaccaccgtgaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1959 - DNA, 3495 bp, Artificial Sequence
  Synthetic Polynucleotide encoding a CAR with optional accessory module(s)
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatccagctgacacagagcccttctagcctgtctgccagcgtgggcgacagagtgaccatcacatgtagagccagccagggcatcagctctgtgctggcttggtatcagcagaagcctggcaaggcccctaagctgctgatctacgatgccagcagcctggaaagcggcgtgccaagcagattttctggcagcggctctggcaccgacttcaccctgacaatatccagcctccagcctgaggacttcgccacctactactgccagcagttcaacagcagcatcaccttcggccagggcaccaagctggaaatcaagagaacagtggcagccggcggaggcggaagtggaggcggaggatctggcggcggaggctctcaagttcagctggttcagtctggggccgaagtgaagaaacctggcagcagcgtgaaggtgtcctgcaaagcaagcggcggcaccttcagcgattacgccatctcttgggtccgacaggcccctggacaaggactggaatggatgggcagaatcatccccatcctgggcgtcgccaattacgcccagaaattccagggccgcgtgacaatcaccgccgacaagtctaccagaaccgcctacatggaactgagcagcctgagaagcgaggacaccgccgtgtactactgcgccagaaattgggccgacgccttcgacatttggggccagggaacaatggtcaccgtgtctagcgcctccacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1960 - DNA, 3492 bp, Artificial Sequence
  Synthetic Polynucleotide encoding a CAR with optional accessory module(s)
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatcgtgatgacacagagccctagcagcctgtctgcctctctcggcggcaaagtgaccatcacatgcaaggccagccaggacatcaacaagtatatcgcctggtatcagcacaagcccggcaagggacctagactgctgatccactacaccagcacactccagcctggcatccccagcagattttctggcagcggctccggcagagactacagcttcagcatcagcaacctggaacctgaggacattgccacctactactgcctccagtacgacaacctgctgacctttggagccggcaccaagctggaactgaaaagaggcggaggcggaagtggaggcggaggatctggcggcggaggctctgaagtgaaactccagcagagcggccctgagctggttaagcctggcaccagcgtgaaggtgtcctgtaaagccagcggctactccttcaccgactacaacatgtactgggtcaagcagagccacggcaagagcctggaatggatcggctacatcgacccctacaaaggcggcaccatctacaaccagaagttcaagggcaaagccacactgaccgtggacaagagcagcagcaccgccttcatgcacctgaacagcctgaccagcgaggacagcgccgtgtactattgcgccagagagatgattaccgcctactacttcgactactggggccagggaagcagcgtgaccgttagctctctggaaagaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1961 - DNA, 3540 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagatagagtgaccatcaactgcaaggccagccaggacatcaacagctacctgagctggttccagcagaagcctggcaaggcccctaagacactgatctaccgggccaacagactggtggatggcgtgccaagcagattttctggcagcggcagcggccaggattacaccctgacaatatccagcctccagcctgaggacttcgccacctactactgcctccagtacgacgagttccctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaagccagcggctacacctttaccaactacgacatcaactgggtccgacaggctccaggccaaggactggaatggatcggctggatctatcctggcgacggcagcaccaagtacaacgagaagttcaaggccaaggccacactgaccgccgataccagcacaagcaccgcctacatggaactgcggagcctgagaagcgacgacaccgccgtgtactattgtgcctccggctacgaggacgctatggactattggggccagggcaccaccgtgacagtgtctagtgccaagcctaccaccacaccagctccaagacctccaactcctgctcctacaatcgccagccagcctctgtctctcagacccgaagcctgtagacctgctgctggcggagctgtgcataccagaggactggatttcgcctgcgacatcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1962 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctctgagcctgcctgttacacctggcgagcctgccagcatctcctgtagaagctctcagagcctgctgcacagcaacggctacaactacctggactggtatctccagaagcctggacagagcccacagctcctgatctacctgggcgtgaactctgtgtccggcgtgcccgatagattttctggcagcggctctggcaccgacttcaccctgaagatcagcagagtggaagccgaggacgtgggcgtgtactactgtatgcaggccctccagacaccttggacattcggccagggcaccaaggtggaaatcaaaggcggcggaggatctggcggaggtggaagtggcggaggcggatctcaagtgcaactggttcagagcggagccgaagtgaagaaacctggcagcagcgtgaaggtgtcctgcaaagcctctggcggcatcttcagcaaccacgccatctcttgggtccgacaggctcctggacaaggactggaatggatgggcggcatcatccccatcttcggcacagccaattacgcccagaaattccagggcagagtgaccatcaccgccgacgagtctaccagcaccgccttcatggaactgagcagcctgagaagcgaggacaccgccgtgtactattgcgccagagaatgggccgacgtgttcgacatttggggccagggaacaatggtcaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1963 - DNA, 3405 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagtctccagccagcctgaccgtgtcactgggacagagagccaccatctcttgcagagccagcgagagcgtggacagctacggcaatagctacctgcactggtatcagcagaagcccggccagcctcctcagctcctgatctacctggcctccaatctggaaagcggcgtgccagccagattttctggcagcggcagcagaaccgacttcaccctgaccattgatcccgtggaagccgatgatgccgccacctactactgccagcagaacaacgaggacccctggacatttggcggaggcaccaaggtggaaatcaaaggcggcggaggatctggcggaggtggaagtggcggaggcggatctgaagttcagctccagcagagcggagccgagcttgtgaaacctggcgcttccgtgaagatgagctgcaaagccttcggctacaccttcaccacctttccaatcgagtggatgaagcagagccacggcaagagcctggaatggatcggcaactttcacccctacaacgaccagaccaagtacaacgaagagttcaagggcagagccaagctgaccatcgacagatccagcagcaccgtgtacctggaactgggcagactgacctccgatgacagcgccgtgtactactgtgccagaggctactactacgccttcgacttttggggccagggcaccacactgacagtgtctagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1964 - DNA, 3396 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatcagaaacgacctcggctggtatcagcagaagcctggcaaggcccctaagcggctgatctatgccgcttcctctctgcaatctggcgtgcccagcagattttctggcagcggctctggcaccgagttcaccctgacaatatccagcctccagcctgaggacttcgccacctactactgcctccagcacaacagctacccctggacctttggacagggcaccaagctggaaatcaaaggcggaggcggaagtggaggcggaggatctggcggcggaggctctgaagtgcaactggttgaatctggcggcgctctgattcagcctggcggatctctgagactgagctgtgtggcctccggctttaccatcagcggcaactacatgagctgggtccgacaggcccctggcaaaggacttgaatgggtgtccctgatctacagcggcgacagcacctattacgccgacagcgtgaagggcagattcaccatcagccgggacatcagcaagaacaccgtgtacctccagatgaactccctgagagtggaagataccgccgtgtactactgcgtccgcgacggctactacgtgtccgatatggttgtgtggggcaagggcaccaccgtgacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1965 - DNA, 3426 bp, Artificial Sequence
  Synthetic Polynucleotide encoding a CAR with optional accessory module(s)
atggccttaccagtgaccgccttgctcctgccgctggccttgctgctccacgccgccaggccggatgtgctgctgacccagagccctctgagcctgcctgtgacactgggacagcctgccagcatctcctgtcggagcagccagaccatcgtgcacagcaacggcaacacctacctggaatggttccagcagcggccaggccagagccccagactgctgatctaccaggtgtccaacagattcagcggcgtgcccgacagattctccggcagcggctctggcaccgacttcaccctgaagatcagccgggtggaagccgaggacgtgggcgtgtactactgttttcaaggcagccacgtgccccggacctttggcggaggaacaaaggtggaaatcaagagaggcggaggcggaagtggaggcggaggatctggcggcggaggctctcagatccaactggtgcagagcggcagcgagctgaagaaacctggggccagcgtgaaggtgtcctgcaaggccagcggctacacctttaccaactacggcatgaactgggtgcgccaggcccctggacagggcctgaaatggatgggctggatcaacaccaacaccggcgagcctaagtacgccgaagagttcaagggcagattcgccctgagcctggacaccagcgtgtccacagcctacctccagatcaacagcctgaaggccgaggataccgccgtgtacttctgcgccagaggctacggcaactacgccagaggggcttggctggcctattggggccagggaacactcgtgaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1966 - DNA, 3387 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccacactctctctgagccctggcgaaagagccaccctgagctgtagcgccagcagcagcatcaactacatctactggctccagcagaagcccggccaggcccccagaatcctgatctacctgaccagcaacctggcctccggcgtgccagccagattttctggcagcggctccggcaccgacttcaccctgacaatcagcagcctggaacccgaggacttcgccgtgtactactgcctccagtggtccagcaaccccctgacctttggcggaggcaccaaggtggaaatcaagggcggaggcggaagtggaggcggaggatctggcggcggaggctctttcgaagtgcaactggtggaaagcgggggaggacttgtgaagcctggcggctctctgagactgagctgtgccgcctctggcttcaccttcagcagctacgacatgagctgggtgcgccaggctcctggcaagggactggaatgggtgtccaccatcagcagcggcggcagctacacctactacctggacagcatcaagggccggttcaccatctccagagacaacgccaagaacagcctgtacctccagatgaactccctgcgggccgaggacacagccgtgtattattgcgccagacagggcctggattactggggcagaggcacccttgtgaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1967 - DNA, 3411 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgccgggccagcaagagcgtgtccaccagcggctacagcttcatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagaggtgccctggacattcggccagggcacaaaggtggaaatcaagcggggcggaggcggaagtggaggcggaggatctggcggcggaggctctcaggtgcagctggtgcagtctggggccgaagtgaagaaacctggggccagcgtgaaggtgtcctgcaaggccagcggatacacctttaccaactacggcatgaactgggtgcgccaggcccctggacagggcctggaatggatgggctggatcaacacctacaccggcgagcccacatacgccgacgccttcaagggcagattcgccttcagcctggacaccagcacctccaccgcctacctccagatcaacagcctgcggagcgacgacaccgccgtgtattattgcgccagagattacggcgactacgggatggactattggggccagggaaccaccgtgaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1968 - DNA, 3399 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacccccctgaccctgagcgtgacaatcggacagcctgccagcatctcctgcaagagcagccagagcctgctggacagcgacggcaagacctacctgaactggctgctgcagaggccaggccagagccccgagagactgatctacctggtgtccaagctggactccggcgtgcccgatagattcacaggcagcggctccggcaccgacttcaccctgaagatcagccgggtggaagccgaggacctgggcgtgtactgttgttggcagggcacccacttcccttacaccttcggcggagggaccaaggtggaaatcaagggcggcggaggcggaagtggaggcggaggatctggcggcggaggctctcaggtgcaactgcagcagcctggcgctgaacttgtgcggccaggcgcctctgtgaagctgagctgtaaagccagcggctacaccttcaccagctactggatgaactgggtcaagcagcgcccaggccagggcctggaatggatcggaatgatcgaccccagcgacagcgagacacactacaaccacatcttcaaggacaaggccaccctgaccgtggacaagtccagcagcacagcctacctgcaactgtccagcctgaccagcgaggacagcgccgtgtactactgcgcccggaacctgtatctgtggggccagggaacaagcgtgaccgtgtctagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1969 - DNA, 3411 bp, Artificial Sequence
  Synthetic Polynucleotide encoding a CAR with optional accessory module(s)
atggccttaccagtgaccgccttgctcctgccgctggccttgctgctccacgccgccaggccggacgacatccagttgacccagtcccccagctcactcagcgccagtgtgggggaccgggtgaccattacctgtaaagccagtcagagtgtggactatgagggggatagcttcctgaattggtatcagcagaagcctggcaaagccccaaagctgctgatctacgctgcatctaatctggagtcaggcgtgccttctaggttctccggtagtgggtctgggaccgatttcacattgaccatttcatccctccaacccgaggatttcgctacatattactgtcagcagtccaatgaggaccctctcacctttggccagggcaccaaagttgaaattaagagaggcggaggcggaagtggaggcggaggatctggcggcggaggctctgaagtccaacttgtggagtctggagggggcctggtgcagcccggcggctctctcagactgtcttgtgcggcaagcggctacaccttcagctcttactggatagaatgggtgaggcaggcacctggaaagggactggagtggattggagagattctgccaggagggggagatacaaattacaatgaaatcttcaaggggcgggccaccttttcagcggataccagcaagaatacagcttacctgcagatgaatagcctccgggcagaagataccgctgtttattattgcacgagacgggtgccaataagactggactattgggggcaagggactcttgtcaccgtcagttcaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1970 - DNA, 3399 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacacctctgagcctgagcgtgacacctggacagcctgccagcattagctgcaagagcagccagtctctgctggacggcgacggcaagacctacctgaattggctgctccagaagcctggacagagccctcagcggctgatctacctggtgtccaagctggatagcggcgtgcccgatagattttctggcagcggctctggcaccgacttcaccctgaagatcagcagagtggaagccgaggacgtgggcgtgtactactgttggcagggcacacacttccccagaacattcggccagggcacaaagctggaaatcaaaggcggaggcggaagtggaggcggaggatctggcggcggaggctctcaagtgcaactggttcagagcggagccgaagtgaagaaacctggggcctctgtgaaggtgtcctgcaaggccagcggctacaccttcaaggacacctacatccactgggtccgacaggcccctggacaaggacttgagtggatgggcagaatcgaccccgccaacggcaacaccaaatacgaccccaagttccagggcagagtgaccatgaccagagacaccagcatcagcaccgcctacatggaactgagccggctgagatccgatgacaccgccgtgtactattgcgctagaagaggcggagtggattggggccagggaacactggttaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1971 - DNA, 3423 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgcgagagcagccagagcctgctgaacagcggcaaccagaagaactacctgacctggtatcagcagaagcccggccagccccccaagcccctgatctattgggccagcaccagagaaagcggcgtgcccgatagattcagcggcagcggaagcggcaccgacttcaccctgaccatcagttctcttcaggccgaggacgtggccgtgtactactgccagaacgactacagctacccctacaccttcggccagggcaccaagctggaaatcaagagaggcggaggcggaagtggaggcggaggatctggcggcggaggctctgaagtgcagctggtgcagtctggggccgaagtgaagaagcctggcgagagcctgaagatcagctgcaagggcagcggctacagcttcaccgactactacatgaagtgggccagacagatgcccggcaagggcctggaatggatgggcgacatcatccccagcaacggggccaccttctacaaccagaaattcaagggccaagtgaccatctccgccgacaagagcatcagcaccacctacctccagtggtccagcctgaaggccagcgacaccgccatgtactattgcgccagaagccatctgctgcgggccagttggttcgcctattggggccagggaacaatggtcacagtgtccagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1972 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaaggcggaggcggaagtggaggcggaggatctggcggcggaggctctcagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1973 - DNA, 3420 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctgaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1974 - DNA, 3420 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1975 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcaggactacggcttcccttggacctttggacagggcaccaaggtggaaatcaagagaggcggaggcggaagtggaggcggaggatctggcggcggaggctctgaagttcaactggttcagagcggagccgaagtgaagaagcctggcgagagcctgaagattagctgcaaaggctccggctactccttcaccagctactggatctcttgggtccgacagatgcccggcaaaggactggaatggatgggcatcatcgaccccagcgacagcgacaccagatacagccctagcttccagggccaagtgaccatcagcgccgacaagagcatcagcacagcctacctccagtggtcctctctgaaggccagcgataccgccatgtactattgcgccagaggcgacggcagcaccgacctggattattggggacagggaaccctggtcaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1976 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccgcagttcgtgctgacacagcctccaagcgtgtccaccaatcctggcagcacagtgaagctgagctgcaagagaaacaccggcaacatcggcagcaactacgtgaactggtatcagcagaagcccggacagagccccaccaccatgatctacagagatgacaagaggcccgacggcgtgcccgatagattttccggctctatcgacagaagcagcaacagcgccctgctgaccatcaacaacgtgcagacagaggacgaggccgactacttctgccagagctacagcagcggcatcaacatcatcttcggcggaggcaccaagctgacagttcttggcggaggcggaagtggaggcggaggatctggcggcggaggctctcaagtgcagctccaagaatctggccctggcctggtcaagcctagcgagacactgagcctgacctgtaccgtgtccggctttagcctgaccacctacgacgtgcactgggtccgacaacctccaggcaaaggactggaatggatgggcagaatccagaacgccggcatcaccgactacaatagcgccctgaagtcccggctgattatctccagagacaccagcaagagccaggtgttcctgaagatgaacagcgtgaccaccgccgacaccgccatgtacttttgtgccaagaccggcagctacttctacgccttcgatcactggggccagggcacactggttaccgtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1977 - DNA, 3399 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagtctccagccagcctgtctgcctctctgggagagacagtgaccatcgagtgcagacccagcgaggacatccacagcaacgtggcctggtatcagcagaagcccggcaattctccccagctgctgatctacgacgccagcaatctggctgatggcgtgcccagcagattttctggcagcggctctggcacacagtacagcctgaagatcaacagcctccagagcgaggacgtggcctcctacttctgccaccagtacaacatctacccctacaccttcggcagcggcaccaagctggaacttaaaggcggaggcggaagtggaggcggaggatctggcggcggaggctctcaagttcagctgcaagagtctggccccacactggtcaagcctggcgatagcgtgaagatgagctgcaaggccagcggctacacctttaccgactacatcatccactgggtcaagcagagccacggcaagagcctggaatggatcggctacatcaacccttacagcgacggcaccaactacaacgagaagttcaagagcaaggccacactgaccgtggacaagagcaccagcacagcctacatggaattttcccggctgacctccgaggacagcgccatctatttctgcgccctgaactacggcagctactacgctatggatgcctggggccagggcacaagcgtgacagtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1978 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacctttggacagggcaccaaggtggaaatcaagagaggcggaggcggaagtggaggcggaggatctggcggcggaggctctgaagttcagctccttgagagtggtggcggcctggttcaacctggcggatctctgagactgtcttgtgccgccagcggcttcacctttagcggctattggatgcactgggtccgacaggcccctggcaaaggacttgaatgggtgtccgccatcagaagcgacggcagcagcaagtactacgccgactctgtgaagggcagattcaccatcagccgggacaacagcaagaacaccctgtacctccagatgaacagcctgagagccgaggacacagccgtgtattattgcgccaaggacggcgtgatcgaggacacctttgattactggggccagggcaccctggtcaccgtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1979 - DNA, 3390 bp, Artificial Sequence
  Synthetic Polynucleotide encoding a CAR with optional accessory module(s)
atggccttaccagtgaccgccttgctcctgccgctggccttgctgctccacgccgccaggccggacgtgcagatcacacagagccctagctacctggctgcctctcctggcgagacaatcaccatcaactgtcgggccagcaagagcatcagcaaggacctggcctggtatcaagagaagcccggcaagaccaacaagctgctgatctacagcggcagcacactccagtctggcatccccagcagattttccggctctggcagcggcaccgatttcaccctgaccataagcagcctggaacctgaggacttcgccatgtactactgccagcagcacaacaagtacccctacacctttggcggaggcaccaagctggaaatcaagagaggcggaggcggaagtggaggcggaggatctggcggcggaggctctcaagttcaactgcaacagcctggggccgagcttgttagacctggcgcttctgtgaagctgagctgcaaggccagcggctacaccttcaccagctactggatgaactgggtcaagcagcggcctgaccagggcctcgaatggatcggcagaatcgacccctacgacagcgagacacactacaaccagaagttcaaggacaaggccatcctgaccgtggacaagagcagctccaccgcctacatgcaactgagcagcctgacctctgaggatagcgccgtgtactattgcgccagaggcaactgggacgactattggggccagggcacaaccctgacagtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1980 - DNA, 3483 bp, Artificial Sequence
  Synthetic Polynucleotide encoding a CAR with optional accessory module(s)
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatccagatgacacagtctccagccagcctgtctgcctctctgggagagacagtgaccatcgagtgccggaccagcaaggacatctacagcaacctggcctggttccagcaagagcccggcaattctcctcagctcctgatctacgacgccagcaatctggctgatggcgtgcccagcagattttctggcagcggctctggcacacagtacagcctccagatcaacaacctccagagcgaggacgtggcctcctacttctgccaccagtacaacaactacccctacaccttcggcaccggcaccaagctggaacttaaaggcggaggcggaagtggaggcggaggatctggcggcggaggctctcaagtgcagctccaagagtctggccccacactggtcaatcctggcgacagcgtgaagatgagctgcaaggccagcggctacacctttaccgaccacatcatccactgggtcaagcagagccacggcaagagcctggaatggatcggctacatcaacccctatagcggcggagccaactacaacggcaagttcaagagcaaggccacactgacaatcgacaagagcagcagcaccgcctacatggaattttccagactgaccagcggcgactccgccatctactactgcgccctgaattacggcagctactacgctatggatgcctggggccagggcacaagcgtgacagtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1981 - DNA, 3396 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctaccagcatgacagcctctccaggcgagcaagtgaccatcacctgtagagccagcagcagcatcaactacatgcactggtatcagcagaagcctggcgcaagccccagaccttggatctacgagacaagcaagctggcctccggcgtgcccgatagattttctggatctgccagcggcaccagctacagcctgaccatcaacaacatggaagccgaggacgccgccacctactactgccagcagtggaattacccctcctggacctttggcggaggcaccaagctggaacttaaaggcggaggcggaagtggaggcggaggatctggcggcggaggctctgaagtgcagctcgttgagtctggtggcggactggttcagcctggaagaagcctgaagctgagctgtgccgccagcggcttcaccttcagcgactacaatatggcctgggtccgacaggcccctaagaaaggactggaatgggtcgccaccatcctgtacgatggcggcagaacctactaccggggcagcgtgaagggcagattcaccatcagcagagacaacgccaagagcaccctgtacctgcggatggactctctgagaagcgaggataccgccacatattactgtgccacacacagccggggcaccgactactttgattattggggccagggcgtgatggttaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1982 - DNA, 3423 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacacagagcccttctagcctggccgtgtctgagggcgagacagtgaccatcaactgcaagagcagccagagcttcctgtctagcggcgacggcaagaattacgtggcctggtatcagtacaagcccggacagagccccaagctgctgatctactgggccagcacaagacagagcggcgtgcccgatagattcatcggctctggcagcggcaccgacttcaccctgacaatctctacagtgcaggccgaggacctggctatctactactgccagcagtattacgacacccctctgacctttggctccggcaccaagctggaaatcaaaggcggaggcggaagtggaggcggaggatctggcggcggaggctctgaagtgaagctgcaagagtctggccccagcctggtgcagagtagccaaacactgagcctgacctgtaccgtgtccggctttagcctgaccagctaccacatccactgggtccgacagacccctggcaaaggactggaatggatgggcgtgatgtggagcgacggcgacaccagctataacagcgccctgaagtcccggctgagcatcagcagagatacaagccagagccaggtgttcctgaagatgaacagcctccagaccgaggacaccgccacctactattgtgccagaggctactacagcagctacctgtacctttggttcgcctattggggccagggcaccctggttacagtcagctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1983 - DNA, 3435 bp, Artificial Sequence
  Synthetic Polynucleotide encoding a CAR with optional accessory module(s)
atggccttaccagtgaccgccttgctcctgccgctggccttgctgctccacgccgccaggccggacgtgctgatgacccagacacctgtgtctctgccagtgtctctcggaggccaggtgtccatctcctgtagaagcagccagagcctggtgcactccgacggcgatacctacctgcactggtatctccagaagcctggacagagccctcagctcctgatctaccgggtgtccaacagattcagcggcgtgcccgatagattttccggcagcggctctggcaccgacttcaccctgaagatcagcagagtggaacccgaggacctgggcctgtactactgtctccagaccacacacttcccaccttggacctttggcggaggcaccaagctggaaatgaaaggcggaggcggaagtggaggcggaggatctggcggcggaggctctcaggttcagctccagcagtctggacccgagcttagaaggccaggatctagcgtcagactgagctgcaaggccagcggctaccggatcaaggacttcctgatccactggattaagaacagacccgagcacggcctggaatggatcggatggattgaccctgaggacggcgagactaagtacgcccagaagttccagaccaaggccacactgaccgccgacacctctagcaacaccgcctacatgcaactgagcagcctgaccagcgaggacaccgccacctacttttgtgctagatggggcgacgtgtactacggcctgatgagaggccatgtgatggatgcctggggccagggaacaagcgtgacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1984 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagtctaccagttccctgagtgcatccctcggagacagggtgacgatcagttgcagcgcaagccaagggatcaataactatctgaactggtatcagcagaaaccggacggaacagtcgaactcctgatttattacaccagcacccttcagagtggcgtcccttcccggttcagtggctccggaagcgggaccgattactccctgaccatttctaatctggagccagaggacataggaacgtattattgccagcagtatagtaaactgccacgaacttttggaggggggacgaaactggagatcaaaggcggaggcggaagtggaggcggaggatctggcggcggaggctctcaggtgcaactccagcagtccggaagcgagcttatgatgccaggggcatcagtgaagatcagctgcaaggctactggctacaccttctctaattactggatagagtgggttaaacaaaggccagggcacggcctggaatggatcggcgagatcctgcctgggacaggccgaaccatttataacgagaagttcaaaggcaaggctactttcaccgcagatataagctctaatacagtgcaaatgcagctctcttccctgacaagtgaggatagtgccgtgtattattgcgcacgaagagattactatggaaatttttattacgctatggattattggggtcaaggaacaagtgtgaccgttagcagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1985 - DNA, 3393 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccctgccagcctgtccgtgtctgtgggcgagacagtgaccatcacctgtcgggccagcgagaacatctacagcaacctggcctggtatcagcagaagcagggcaagagcccccaactgctggtgtacgccgccaccaatctggccgatggcgtgcccagcagattttccggctctggcagcggcacccagtacagcctgaagatcaacagcctccagagcgaggacttcggcagctactactgccagcacttctggggcacctggacctttggaggaggcaccaccctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccgactactacatgaagtggatgaagcagagccacggcaagtccctggaatggatcggcgacatcaaccccaacaacggcggcaccacctacaaccagaagttcaagggcaaggccaccctgaccgtggacaagagcagcagcaccgcctacatgcaactgaacagcctgaccagcgaggacagcgccgtgtactactgcgccagagactacggctacggctatttcgactactggggccagggcacaaccctgacagtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1986 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggcctctcagagcgtgggaggctacctggcttggtatcagcagaagccaggccaggcccccagactgctgatctacgacgccagcaatcgggccacaggcatccccgccagattttctggcagcggctccggcaccgacttcaccctgacaatcagcagcctggaacccgaggacttcgccgtgtactactgccagcagcggaacaactggccccccatgtacacattcggccagggcaccaagctggaaatcaagagaggcggaggcggaagtggaggcggaggatctggcggcggaggctctcaggtgcaactggtgcagagcggagccgaagtgaagaaacccggcagcagcgtgaaggtgtcctgcaaggcttccggcggcaccttcagcagctacgccatttcttgggtgcgccaggctcctggacagggcctggaatggatgggcggcatcatccctatcctgggcaccgccaactacgcccagaaattccagggcagagtgaccatcaccgccgacgagagcaccagcaccgcctacatggaactgagcagcctgcggagcgaggacacagccgtgtattattgcgccagatggggcggaggggccttcgacatttggggccagggaacaatggtcaccgtgtccagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1987 - DNA, 3387 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgacacagagccctgccctgatgagcgccagccctggcgagaaagtgaccatgacctgtagcgccagcagcagcgtgcgctacatgtactggtatcagcagaagcccagaagcagccccaagccctggattcacctgaccagcaatctggcctctggcgtgcccgctagattttccggctctggcagcggcaccagctacagcctgaccatcagcagcatggaagccgaggacgccgccacctactactgccagcagtggtccagccaccccttcacatttggctccggcaccaagctggaaatcaagggcggaggcggaagtggaggcggaggatctggcggcggaggctctgatgtgcaactccaggaaagcggccctggccttgtgaagcctagccagagcctgtccctgacctgtaccgtgaccggcttcagcatcaccagcgactactcttggaactggatcagacagttccctggcaacaaactggaatggatgggctacatcagctactccggccacacctcctacaaccccagcctggaaagccggatctccatcaccagagacaccagcaagaaccagttcttcttgcaactgaacagcgtgaccaccgaggataccgccacatattactgtaccagaggcaactgggacgtggtgtactggggccagggcacacttgtgaccgtgtctgctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1988 - DNA, 3417 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagagccctctgagcctgcctgtgacactgggacagcctgccagcatctcctgtcggagcagccagagcatcgtgcacagcgacggcaacacctacctggaatggtatcagcagcggccaggccagagccccagacggctgatctacaaggtgtccaacagattcagcggcgtgcccgacagattctccggcagcggctctggcaccgacttcaccctgaagatcagcagagtggaagccgaggacgtgggcgtgtactactgttttcaaggcagccacgccccctggacctttggcggaggaacaaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagctacggaatgcactgggtgcgccaggcccctggcaaaggactggaatgggtggcctacatcaccaccagaagcagcaccatctactacgccgacagcgtgaagggccggttcaccatctccagagacaacgccaagaacagcctgtacctccagatgaactccctgcgggccgaggacaccgccgtgtactattgcaccagagagcccctgaccggctactacgctatggactattggggccagggcaccagcgtgaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1989 - DNA, 3393 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcctgtggctgaactggtatcagcagaagcccggcaaggcccccaagctgctgatctacgccgccagcacactccagagcggcgtgccaagcagattttccggcagcggctccggcaccgacttcaccctgacaatcagctccctccagcccgaggacttcgccacctactactgccagcagtactacaccagcccctacaccttcggccagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagctacgccatgagctgggtgcgccaggcccctggaaaaggactggaatgggtgtccgtgatccggtccagcggcagcagcacctattacgccgatagcgtgaagggccggttcaccatcagccgggacaacagcaagaacaccctgtacctccagatgaacagcctgcgggccgaggacaccgccgtgtactattgtgctaggggaggcggctacttcgactactggggccagggaacactcgtgaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1990 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgtgtccacactccagagcggcgtgcccagcagattttctggcagcggctccggcaccgacttcaccctgacaatcagctccctccagcccgaggacttcgccacctactactgtcagcagagcggcaccttccctcccaccacatttggacagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagccacggaatgcactgggtgcgccaggcccctggaaagggactggaatgggtgtccgtgatctccggcagcggcagcaataccggctacgccgatagcgtgaagggccggttcaccatcagccgggacaacagcaagaacaccctgtacctccagatgaacagcctgcgggccgaggacaccgccgtgtactattgtgccagacagtggggcagctacgccttcgattcttggggccagggcaccctcgtgaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1991 - DNA, 3432 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgagccagagccctagcagcctggccgtgtccgtgggcgagaaagtgaccatgagctgcaagagcagccagtccctgctgcacagcagcaaccagaagaactacctggcctggtatcagcagaagcccggccagtcccccaaggtgctgatctactgggccagcaccagagaaagcggcgtgcccgatagattcaccggcagcggctctggcaccgacttcaccctgaccatcaccagcgtgaagtccgaggacctggctgtgtactactgccagcagtattacagctacccctggaccttcggcggaggcacccggctggaaatcaaaagaggcggaggcggaagtggaggcggaggatctggcggcggaggctctgaagtgcaactccagcagagcgtggccgagcttgtgaagcctggcgcttccgtgaagatgtcctgcaaggtgtccggctacaccctgacagaccacaccatccactggatgaagcagcggcctgagcagggcctggaatggatcggctacatctaccccagggacggcatcaccggctacaacgagaagttcaagggcaaggccacactgaccgccgacaccagcagcagcacagcctacatgcaactgaacagcctgaccagcgaggacagcgccgtgtacttctgtgccagatggggctacagctacagaaactacgcctactactacgactactggggccagggcacaaccctgaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1992 - DNA, 3423 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctacggaacaagcagcagagccaccggcatccccgacagattttctggcagcggctccggcaccgacttcaccctgacaatcagcagactggaacccgaggacttcgccgtgtactactgccagcagtacggcagcagccccttcacctttggcggaggcaccaaggtggaaatcaagagaggcggaggcggaagtggaggcggaggatctggcggcggaggctctcaggtgcaactccaggaatctggccccggactggctaagcccagcgagacactgagcctgacctgtaccgtgtccggcgacagcatcaccagctactactggtcctggatcagacagccccctggcaagggcctggaatggatcggctacatctactacagcggcagcaccaactacaaccccagcctgaagtccagagtgaccatcagcgtggacaccagcaagaaccagttctccctgaagctgagcagcgtgacagccgccgacaccgccgtgtattattgcgccagagatcagcggagaatcgccgctgccggcacccacttttacggcatggatgtgtggggccagggcaccaccgtgaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1993 - DNA, 3399 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacccagagccccgtgatcctgtccgtgtctcctggcgagagagtgtccttcagctgtcgggccagccagagcatcggcaccaacatccactggtatcagcagcggaccaacggcagccccagactgctgattaagtacgccagcgagtccatcagcggcatccccagcagattttccggcagcggctccggcaccgacttcaccctgagcatcaacagcgtggaaagcgaggacattgccgactactactgccagcagaacaacaactggcccaccaccttcggagccggcaccaagctggaactgaagggcggaggcggaagtggaggcggaggatctggcggcggaggctctcaggtgcagctgaagcagagcggacctggcctggtgcagcctagccagagcctgtccatcacctgtaccgtgtccggcttcagcctgaccaactacggcgtgcactgggtgcgccagagccctggaaaaggactggaatggctgggagtgatttggagcggcggcaacaccgactacaacacccccttcaccagcagactgtctatcaacaaggacaacagcaagagccaggtgttcttcaagatgaacagcctccagagcaacgacaccgccatctactactgtgctagagccctgacctactatgactacgagttcgcctactggggccagggcacactcgtgacagtgtctgctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1994 - DNA, 3378 bp, Artificial Sequence
  Synthetic Polynucleotide encoding a CAR with optional accessory module(s)
atggccttaccagtgaccgccttgctcctgccgctggccttgctgctccacgccgccaggccgatgacccagagccccaagttcctgctggtgtctgccggcgacagagtgaccctgacatgcaaggccagccagagcgtgaacaacgacgtgtactggtatcagcaggaacccggccagtcccccaagctgctgatctactgggccagcaccagagaaagcggcgtgcccgatagattcaccggcagcggctctggcaccgacttcaccctgacaatcagcagcgtgcaggccgaggacctggccgtgtactactgcaagcagagctacaacctgtacaccttcggcggaggcaccaagctggaaatcaagagaggcggcggaggatctggcggaggcggatctgggggcggaggctctgaatctggaagaggactggtgcagcctggcggcagcagaaagctgtcttgtgccgccagcggcttcaccttcagcaccagcggaatgcactgggtgcgccaggcccctgagaagggactggaatgggtggcctacatcagctccggcagcaccaccatctaccacgccgataccgtgaagggccggttcaccatcagccgggacaaccccaagaataccctgttcctccagatgaccagcctgcggagcgaggacaccgccatgtactattgctgcgccagaagcggccagttcggcaactacttcgactactggggccagggcaccaccctgaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1995 - DNA, 3393 bp, Artificial Sequence
  Synthetic Polynucleotide encoding a CAR with optional accessory module(s)
atggccttaccagtgaccgccttgctcctgccgctggccttgctgctccacgccgccaggccgcagagcccatctagcctggctgtgtctgccggcgagaaagtgaccatgagctgcaagagcagccagagcctgctgaacagccggacccggaagaactacctggcctggtatcagcagaagcccggccagagccccaagctgctgatctactgggccagcaccagagaaagcggcgtgcccgatagattcaccggctctggcagcggcaccgacttcaccctgacaatcagcagcgtgcaggccgaggacctggccgtgtactactgcaagcagagcaacctgtacaccttcggcggaggcaccaagctggaaatcaagggcggaggcggaagtggaggcggaggatctggcggcggaggctctcaggtgcagctggaagagtctggacccgagcttgtgaagcctggggccagcgtgaagctgtcctgtaaagccagcggctacaccttcaccgagtacatcatccactgggtcaagcagcggagcggccagggcctggaatggatcggctggttttaccctggctccggcagcatcaagtacaacgagaagttcaaggacaaggccaccctgaccgccgacaagtccagcagcaccgtgtacatggaactgagcggcctgaccagcgaggacagcgccgtgtatttctgcgccagacacgacggctacagctacttcgactattggggccagggcaccacactgaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1996 - DNA, 3429 bp, Artificial Sequence
  Synthetic Polynucleotide encoding a CAR with optional accessory module(s)
atggaaatgttccagggcctgctgctgctcctgctgctttctatgggaggcacatgggccagcagagagatgctgaggcccagatgcagacccatcaatgccacactggccgtggaaaaagagggctgccctgtctgcatcaccgtgaacaccacaatctgcgccggctactgccccaccatgacaagagttctgcaaggcgtgctgcccgctctgcctcaggtcgtgtgcaactatcgggacgtccgcttcgagagcatcagactgcctggatgtcccagaggcgtgaaccctgtggtgtcttatgccgtggctctgagctgtcagtgcgccctgtgtagaagaagcaccaccgattgcggcggacccaaggatcaccctctgacctgtgacgaccctagattccaggccagcagcagctctaaagcccctccaccttctctgccatctccaagcagactgcccggacctagcgacacacctattctgcctcaaggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1997 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgcctctctgggcgagagagtgtccctgacctgtcgggccacacaggaactgagcggctacctgtcttggctgcagcagaagcccgacggcaccatcaagcggctgatctacgccgccagcaccctggatagcggcgtgcccaagagattcagcggcaacagaagcggcagcgactacagcctgaccatcagctccctggaaagcgaggacttcgccgactactactgcctgcagtacgccatctacccctacaccttcggcggaggcaccaagctggaaatcaagggcggaggcggaagtggaggcggaggatctggcggcggaggctctgaggtgcaactgcagcagtctggccccgagcttgtgaagcctggcgcctccgtgaagatgagctgcaaggccagcggctacacctttaccagctacttcatccactgggtcaagcagaaacccggccagggcctggaatggatcggcttcatcaacccttacaacgacggcagcaagtacaacgagaagttcaagggcaaggccaccctgaccagcgacaagagcagcagcaccgcctacatggaactgtccagcctgacatccgaggacagcgccgtgtactactgcaccagggacgacggctactacggctacgccatggactactggggccagggaacaagcgtcaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1998 - DNA, 3417 bp, Artificial Sequence
  Synthetic Polynucleotide encoding a CAR with optional accessory module(s)
atggccttaccagtgaccgccttgctcctgccgctggccttgctgctccacgccgccaggccggacaccatcgtgctgacacagagccctgcttccctggccgtgtccctgggacagagagccaccatctcttgcagagccagcgagagcgtggacagctacggcaacagcttcatgcactggtatcagcagaagcccggccagccccccaagctgctgatctacctggcctccaacctggaaagcggcgtgcccgccagattttctggcagcggcagcagaaccgacttcaccctgaccatcgaccccgtggaagccgatgatgccgccacctactactgccagcagaacaactacgacccctggaccttcggcggaggcaccaagctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccagctacgtgatgcactgggtcaagcagaaacctggacagggcctggaatggatcggctacatcaacccctacaacgacggcaccaagtacaacgagaagttcaagggcaaggccaccctgacaagcgacaccagcagcagcaccgcctacatggaactgaacagcctgaccagcgaggacagcgccgtgtacttctgcgccagacccatctacttcgacaacgactacttcgattactggggccagggcaccaccctgaaggtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1999 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagccaggatgtgtctacagccgtggcctggttccagcagaagcctggaaaagcccctaagctgctgatctacagccccagctacagatacaccggcgtgcccagcagattttctggcagcggctctggcaccgacttcaccctgacaatatccagcctccagcctgaggacttcacctactactgccagcagctctacagcaccccttacacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaagccagcggctacacctttaccgactactacctggacgtggtcgtgcggcaagctcctggacaaggactggaatggatcggcagagtgaacccctacaacggcggcaccatctacaaccagaaattcaagggaagagtgaccctgaccagagacaccagcacctccacagcctacctggaactgagcagcctgagaagcgaagataccgccgtgtactactgcgccagggaccactacagatatgaccctctgctggactactggggccagggaaccctggttacagtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2000 - DNA, 3420 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagagcgtgtccaccagcagctacaactacatgcactggtatcagcagaagcccggcaagcctcctaagctgctgattaagtacgccagcaacctggaaagcggcgtgcccagcagattttctggcagcggctctggcaccgacttcaccctgacaatatccagcctccagcctgaggacttcgccacctactactgtcagcactcctgggagatccctctgacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggccagcggctacagcttcaccgactattatatgcactgggtccgacaggctccaggccagggacttgagtggatcggcagaatcaacccctacaacggcgctgccttctacagccagaacttcaaggatagagtgaccctgaccgtggacaccagcaccagcacagcctacctggaactgagcagcctgagaagcgaggacaccgccgtgtactactgcgccattgagagaggcgctgacctggaaggctacgctatggattattggggccagggaaccctggtcaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2001 - DNA, 3414 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctccagccacactgagcgcttctccaggcgagagagtgaccctgacctgtagagccagcagcaacgtgatctccagctacgtgcactggtatcagcagaagcctggcagcagccccagactgtttctgtacagcaccagcaatctggcctccggcgtgccaagcagattttctggctctggcagcggcaccgacttcacctttaccatctctagcctggaagccgaggacgccgccacctactactgtcagcagtacagcggctaccctctgaccttcggccagggcacaagactggaaatcaaaggcggaggcggaagtggaggcggaggatctggcggcggaggctctcaagttcagctgcaagagtctggccctggcctggtcaagcctagcgaaacactgagcctgacctgcgccgtgtctggctactctatcaccagcgcctactattggaactggatcagacagcctcctggcaaaggactggaatggatcggctacatcagctacgacggcagaaacaactacaaccccagcctgaagaaccggatcaccatcaatcccgacaccagcaagaaccagttcagcctccagctgaacagcgtgacccctgaggataccgccgtgtactactgtgccagagaaggcgactacgacgtgggcaactactacgctatggactactggggccagggaaccctggtcacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2002 - DNA, 3414 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcagcaacgtgatctccagctacgtgcactggtatcagcagaagcctggacaggcccctcggctgctgatctacagcacaagcaatctggcctctggcatccccgccagattttctggctctggaagcggcaccgacttcaccctgaccataagcagcctggaacctgaggacttcgccgtgtactactgccagcagtatagcggctaccctctgaccttcggccagggcacaagactggaaatcaaaggcggaggcggaagtggaggcggaggatctggcggcggaggctctgaagtgcaactggtggaaagtggcggcggactggtgcaacctggaagaagcctgagactgtcctgtgccgccagcggctactctatcacaagcgcctactactggaactgggtccgacaggctcctggcaaaggactggaatgggtgtcctacatcagctacgacggcagaaacaactacaaccccagcctgaagaaccgcttcaccatcagccgggacaacgccaagaagtccctgtacctccagatgaacagcctgagagccgaggacacagccctgtactattgcgccaaagagggcgactacgacgtcggcaactactacgctatggactactggggccagggaaccaccgtgactgtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2003 - DNA, 3450 bp, Artificial Sequence
  Synthetic Polynucleotide encoding a CAR with optional accessory module(s)
atggccttaccagtgaccgccttgctcctgccgctggccttgctgctccacgccgccaggccggacctgaacttcatgctgacccagccccacagcgtgtccggcagccctggaaagaccgtgaccatctcctgcaccagaagcaccggcagcatcaccagcaactacgtgcactggtatcagcagaggcccggcagcagccctaccaccgtgatctgcgaggacaacgagaggccaagcggcgtgcccgatagattcagcggctccatcgacatcagcagcaacagcgccagcctgaccatcagcggcctgaaaaccgaggacgaggccgactactactgccagagctacgacgacagcaaccacatctccgtgttcggcaccgggaccaaagtgaccgtgctgggacagcccaaggccaatcctggcggaggcggaagtggaggcggaggatctggcggcggaggctctcaggtgcaactgcaggaatctggccctggcctcgtgaagcccagcgagacactgagcctgacctgcacagtgtccggcggcagcattagcagcagcaattactactggggctggattcggcagccccctggcaagggactggaatggatcggagccatctactacagcggcagcacctactacaaccccagcctgaagtccagagtggctatcagcgtggacaccagcaagaaccagttctccctgaagctgagcagcgtgacagccgccgataccgccgtgtactactgcgccagacggatcggagtggccggacagtggtacttcgacctgtggggcagaggaaccctcgtgaccgtgtctagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2004 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgagcgccagcgtgggcgacagagtgaccatcacctgcaaggccagccaggacgtgggcatcgccgtggcctggtaccagcagaagcccggcaaggtgcccaagctgctgatctactgggccagcaccagacacaccggcgtgcccgacagattcagcggcagcggcagcggcaccgacttcaccctgaccatcagcagcctgcagcccgaggacgtggccacctactactgccagcagtacagcagctacccctacaccttcggccagggcaccaaggtggagatcaagggcggaggcggaagtggaggcggaggatctggcggcggaggctctcagatccagttggtgcagtctggacctgacctgaagaagcctggagagacagtcaagatcagttgcaaggcttctgggtataccttcacaaacactggaatgaactgggtgaagcaggctccaggaaagggtttaaagtggatgggctggataaatacctacactggagagccaacatacgctgatgacttcaagggacggtttaccttctctttggaaacctctgccagcactgcctatttgcagatcaacaacctcaaaaatgaggacacggctacatatttctgtacaagatggggctacggtagtagcctttattatgctatggactactggggtcaaggaacctcagtcaccgtctcctcaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2005 - DNA, 3399 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgggaatcgccgtggcctggtatcagcagaaacccggcaaggtgcccaagctgctgatctactgggccagcaccagacacaccggcgtgcccgatagattttccggcagcggctccggcaccgacttcaccctgacaatcagctccctccagcccgaggacgtggcaacctactactgccagcagtacagcagctacccctacaccttcggccagggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcgacttcagccggtactggatgagctgggtgcgccaggcccctggcaaaggactggaatggatcggcgagatcaaccccgacagcagcaccatcaactacgcccccagcctgaaggacaagttcatcatcagccgggacaacgccaagaacagcctgtacctccagatgaactccctgcgggccgaggacaccgccgtgtactattgcgccagacccgacggcaactactggtacttcgacgtgtggggccagggaaccctcgtgaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2006 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccagaagagcatgagcaccagcgtgggcgacagagtgagcatcacctgcaaggccagccaggacgtgatcaccggcgtggcctggtaccagcagaagcccggccagagccccaagctgctgatctacagcgccagctacagatacaccggcgtgcccgacagattcaccggcagcggcagcggcaccgacttcaccttcaccatcagcaacgtgcaggccgaggacctggccgtgtactactgccagcagcactacagcacccccctgaccttcggcgccggcaccaagctggagctgaagggcggaggcggaagtggaggcggaggatctggcggcggaggctctcaggtgcagctgcagcagcccggcgccgagctggtgagacccggcgccagcgtgaagctgagctgcaaggccagcggctacagcttcaccacctactggatgaactgggtgaagcagagacccggccagggcctggagtggatcggcatgatccaccccagcgacagcgagaccagactgaaccagaagttcaaggacaaggccaccctgaccgtggacaagagcagcagcaccgcctacatgcagctgagcagccccaccagcgaggacagcgccgtgtactactgcgccagaagcaccatgatcgccaccagagccatggactactggggccagggcaccagcgtgaccgtgagcagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2007 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagccaggatgtgtctacagccgtggcctggtatcagcagaagcctggaaaggcccctaagctgctgatctacagcgccagctacagatacaccggcgtgcccgatagattcacaggctctggcagcggcaccgacttcaccctgacaatatctagcctccagcctgaggacttcgccacctactactgccagcagcactacagcacccctccatacacatttggcggaggcaccaaggtggaaatcaagagaggcggaggcggaagtggaggcggaggatctggcggcggaggctctcaagttcaactggttcagagcggagccgaagtgaagaaacctggggcctctgtgaaggtgtcctgcaaagccagcggctacgcctttagcagctcctggatgaactgggtccgacaggctcctggacagggcctcgaatggatcggcagaatctatcctggcgacggcgacaccaagtacaacggcaagttcaagggcaaagccacactgaccgccgacaagagcacaagcaccgcctacatggaactgagcagcctgagaagcgaggacaccgccgtgtactactgtgccagatccaccatgatcgccaccggcgctatggattattggggccagggaaccctggtcaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2008 - DNA, 3411 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagacacctctgagcctgagcgtgacacctggacagcctgccagcatcagctgtagaagcagccagagcctggtgcacaacaacggcaacacctacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacacacgtgccaccttacacctttggcggaggcaccaaggtggaaatcaaaggcggaggcggaagtggaggcggaggatctggcggcggaggctctgaagtgcagctggttgagtctggtggcggactggttcaacctggcggaagcctgagactgtcttgtgccgccagcggcttcaccttcagcgactactatatggcctgggtccgacaggcccctggcaaaggacttgaatgggtcgccgagatcaactacgacggcagcagcacctactacgtggacagcgtgaagggcagattcaccatcagccgggacaacgccaagaacagcctgtacctccagatgaactccctgagagccgaggataccgccgtgtactactgcgccagagacagaggcttctacttcgactattggggccagggcaccaccgtgacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2009 - DNA, 3411 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagacacctctgagcctgagcgtgacacctggacagcctgccagcatctcctgtagaagcagccagagcctggtgcacagcaacggcctgacatacctgcactggtatctccagaagcctggacagagccctcagctcctgatctacaaggtgtccaacagattcagcggcgtgcccgacagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccagcatcaactacgacggcgagagcacctactacgtggacagcgtgaagggcagattcaccatcagccgggacaacgccaagaacagcctgtacctccagatgaactccctgagagccgaggataccgccgtgtactactgcgccagagacagaggctactacttcgactattggggccagggcaccaccgtgacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2010 - DNA, 3411 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagccctctgagcctgcctgtgacacctggcgaacctgccagcatctcctgtagaagcagccagagcctggtgcacagcaacggcaatacctacctgcactggtatctccagaagcctggacagagcccacagctcctgatctacaaggtgtccaaccggttcagcggcgtgcccgatagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccgacatcaactacgatggcggcagcacctactacctggacagcctgaagtcccggttcaccatctccagagacaacgccaagaacagcctgtacctccagatgaactccctgagagccgaggataccgccgtgtactactgcgccagagacagaggctactacttcgactattggggccagggcaccctggtcacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2011 - DNA, 3405 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagcagcagctacctgagcgtgtcccttggcggcagagtgaccatcacctgtaaagccagcgaccacatcaacaactggctggcctggtatcagcagaagcctggcaacgcccctagactgctgattagcggagccacctctctggaaacaggcgtgccaagcagattttccggcagcggctctggcaaggactacaccctgagcatcaccagcctccagaccgaggatgtggctacctactactgccagcagtattggagcaccccttggacctttggcggaggcaccaagctggaaatcaaaggcggaggcggaagtggaggcggaggatctggcggcggaggctctcaggttcagctccagcagtctggcgctgagcttgctagacctggcgcttctgtgaagctgagctgcaaggccagcggctacaccttcaccagctactggatgcagtgggtcaagcagaggccaggccaaggactggaatggatcggagccatctatcccggcgacggcgataccagatacacccagaagttcaagggcaaagccacactgaccgccgacaagagcagctccacagcctacatgcaactgagcagcctggcttccgaggacagcgccgtgtactattgtgccagaggcaaggtgtactacggcagcaaccctttcgcctattggggccagggaaccctggttacagtgtctgctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2012 - DNA, 3405 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccacaagttcatgagcaccagcgtgggcgacagagtgtccatcacctgtaaagccagccaggacgtgtcaacagccgtggcctggtatcagcagaagcctggacagagccccaagctgctgatctacagcgccagctacagatacaccggcgtgcccgatagattcacaggctctggcagcggcaccgacttcacctttacaatcagcagcgtgcaggccgaggacctggccgtgtattattgccagcagcactacagcacccctccatacacatttggcggaggcaccaagctggaaatcaaaggcggaggcggaagtggaggcggaggatctggcggcggaggctctcaggttcagctccagcagtctggccctgagcttgtgaaacctggcgcttccgtgaagattagctgcaaggccagcggctacgccttcagcagctcctggatgaactgggtcaagcagaggccaggccagggcctcgaatggatcggcagaatctatcctggcgacggcgacaccaagtacaacggcaagttcaagggcaaagccacactgaccgccgacaagtctagcagcaccgcctatatgcagctcagcagcctgacctctgtggacagcgccgtgtacttctgtgcccggtctaccatgattgccaccggcgctatggattactggggccagggaacaagcgtgaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2013 - DNA, 3420 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgtgccacagtggaagccggcctgagcggctctgtgtttggcggcggaacaaagctgaccgtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgcgccatcgtgggcagcttcagccctctgacactgggcctgtggggccagggaactatggtcaccgtgtccagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2014 - DNA, 3420 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgccagagctacgacagcagcagcatcagcaccatcttcggcggaggcaccaagctgacagtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgtgccatcgtgggcagcttcagcggaatcgcctacagaccttggggccagggcacaatggtcaccgtgtctagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2015 - DNA, 3453 bp, Artificial Sequence
  Synthetic Polynucleotide encoding a CAR with optional accessory module(s)
atggccttaccagtgaccgccttgctcctgccgctggccttgctgctccacgccgccaggccggacgaattcgaggtgcagctggtagaatccggcgggggacttgtacaggctggtggtagtctgagactgagctgtgtggcctccggcatcagcagcagcaagcggaacatgggatggtataggcaagcccctggtaagcagagggaatccgtggctacaatcagcagcggcggcaacaaggactacaccgacgccgtgaaggacaggttcaccatctccagggacaccaccaagaacaccgtgtacctgcagatgaactccctcaagcccgaggacaccgccgtgtactactgcaagatcgaggccggcacaggctgggccaccagaagaggctacacatactgggggcagggaacactggtgaccgtgagctccctcgagggcggaggcggaagtggaggcggaggatctggcggcggaggctctttcgaagttcaactggtggaatccggtggaggactggtgcaagcgggcggctcactgcgccttagctgtgctgccagcggcagtatcttcagcggcaatgtaatgggttggtacaggcgacaagccccaggcaaggagcgagagtgggtagccgcgattgcaagtgggggcagcatctactacagagattctgtgaaaggccgcttcactattagtcgggacaacgcaaaaaacacggtgtatctccaaatgaacagcttgaagccagaggacactgctgtctactattgtaacagtcatcccccaactctcccctattgggggctgggcactcaggtcaccgtgagttccacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2016 - DNA, 3555 bp, Artificial Sequence
  Synthetic Polynucleotide encoding a CAR with optional accessory module(s)
atggccttaccagtgaccgccttgctcctgccgctggccttgctgctccacgccgccaggccggacgaattcgaggtgcaactggtggaaagcggcggaggactggtgcaggctggcgatagcctgagactgagctgtgccgcctccggcagagccttcagcagatatgccatgggctggttcagacaggcccctggcaaagaacgcgagttcgtggccgccatcggctggggacctagcaagaccaactacgccgacagcgtgaagggccggttcaccatcagccgggacaacgccaagaacaccgtgtacctgcagatgaacaccctgaagcccgaggacaccgccgtgtactcttgcgccgccaagttcgtgaacaccgacagcacctggtcccgcagcgagatgtacacctattggggccagggcaccctcgtgaccgtgtctagtctcgagggaggaggcggctccgggggaggcggaagtggaggcggaggatctgggtctggaggaagcggatctggaggctcagggtcagggggctcaggcagtggaggctctttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2017 - DNA, 3414 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagcgccagcagcagcgtgtcctacatgtactggtatcagcagaagcccggcaaggcccccaagctgctgatctacctgaccagcaatctggcctccggcgtgcccagcagattttctggcagcggctccggcaccgacttcaccctgacaatcagctccctccagcccgaggacttcgccacctactactgtcagcagtggcggagcaaccccttcaccttcggccagggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcacaagcggcatgggcgtgggctggatcagacagcctcctggaaaggccctggaatggctggcccacatttggtgggacgacgtgaagcggtacagccccagcctgaagtcccggctgaccattaccaaggacaccagcaagaaccaggtggtgctgaccatgacaaacatggaccccgtggacaccgccacatattactgcgcccggatcgtgtccttcgacaacgacgtggtgtccgctatggactactggggccagggaaccctcgtgaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2018 - DNA, 3399 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtccgtgtctccaggcgaaagagccaccctgagctgcaaggcttcccagagcgtgtccaacgacgtcgtgtggtatcagcagaagcccggccaggcccccagactgctgatctactacgccagcaacagatacaccggcatccccgccagattcagcggctctggcagcggcaccgagttcaccctgacaatcagcagcctccagagcgaggacttcgccgtgtactactgtcagcaggactacaccagcccctggaccttcggccagggcaccaagctggaaatcaagagaggcggaggcggaagtggaggcggaggatctggcggcggaggctctcaggtgcaactggtgcagagcggagccgaagtgaagaaacctggggccagcgtgaaggtgtcctgcaaggccagcggctacacctttaccaactacggcatgaactgggtgcgccaggctcctggacagggcctggaatggatgggctggatcaacacctacaccggcgagcccacctacgccgacgacttcaagggcagagtgaccatgaccaccgacaccagcacctccaccgcctacatggaactgcggagcctgagaagcgacgacaccgccgtgtattattgcgcccggatcggcgacagcagccccagcgattattggggccagggaaccctcgtgaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2019 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggacagcaccgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacctggccagcaacctgcagagcggcgtgcccagcagattttctggcagcggctccggcaccgacttcaccctgacaatcagctccctgcagcccgaggacttcgccacctactactgtcagcaggccgagtacatgcccctgaccttcggccagggaacaaaggtggaaatcaagagagccggcggaggcggaagtggaggcggaggatctggcggcggaggctctgaagtgcaactgctggaatctggcggcggactggtgcagcctggcggatctctgagactgagctgtgccgccagcggcttcacctttagcggctacgccatgagctgggtgcgccaggctcctggcaaaggcctggaatgggtgtccgagatcgcccctcccggcctgaataccagatacgccgatagcgtgaagggccggttcaccatcagccgggacaacagcaagaacaccctgtacctgcagatgaacagcctgcgggccgaggataccgccgtgtactactgcgccaagagcgacaccgccttcgactactggggacagggaacccttgtgaccgtgtccacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2020 - DNA, 3411 bp, Artificial Sequence
  Synthetic Polynucleotide encoding a CAR with optional accessory module(s)
atggccttaccagtgaccgccttgctcctgccgctggccttgctgctccacgccgccaggccggaccaggccgtgctgacccaggagagcgccctgaccaccagccccggcgagaccgtgaccctgacctgcagaagcagcaccggcgccgtgaccaccagcaactacgccaactgggtgcaggagaagcccgaccacctgttcaccggcctgatcggcggcaccaacaacagagtgcccggcgtgcccgccagattcagcggcagcctgatcggcgacaaggccgccctgaccatcaccggcgcccagaccgaggacgaggccatctacttctgcgtgctgtggcacagcaaccactgggtgttcggcggcggcaccaagctgaccgtgctgggcggaggcggaagtggaggcggaggatctggcggcggaggctctgacgtgcagctggtggagagcggcggcggcctggtgcagcccggcggcagcagaaagctgagctgcgccgccagcggcttcaccttcagcagcttcgggatgcactgggtgagacaggcccccgagaagggcctggagtgggtggcctacatcagcagcggcagcagcaccctgcactacgccgacaccgtgaagggcagattcaccatcagcagagacaaccccaagaacaccctgttcctgcagatgaccagcctgagaagcgaggacaccgccatgtactactgcgccagatggggcaactacccccactacgctatggactactggggccagggcaccagcgtgaccgtgagcagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2021 - DNA, 3057 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcaactggtggaaagcggcggaggctctgtgcagacaggcggctctctgagactgacctgtgccgccagcggcagaaccagcagatcctatggcatgggctggttcagacaggcccctggcaaagaacgcgagttcgtgtccggcatctcttggagaggcgacagcaccggctacgccgatagcgtgaagggccggttcaccatcagccgggacaacgccaagaacaccgtggacctgcagatgaacagcctgaagcccgaggacaccgccatctactactgtgccgctgccgccggatctgcttggtacggcacactgtacgagtacgactactggggccagggcacccttgtgaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2022 - DNA, 3483 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcaactggtggaaagcggcggaggctctgtgcagacaggcggctctctgagactgacctgtgccgccagcggcagaaccagcagatcctatggcatgggctggttcagacaggcccctggcaaagaacgcgagttcgtgtccggcatctcttggagaggcgacagcaccggctacgccgatagcgtgaagggccggttcaccatcagccgggacaacgccaagaacaccgtggacctgcagatgaacagcctgaagcccgaggacaccgccatctactactgtgccgctgccgccggatctgcttggtacggcacactgtacgagtacgactactggggccagggcacccttgtgaccgtgtcatctctcgagggcggaggcggaagtggaggcggaggatctggcggcggaggctctttcgaagaggtgcaactggtggaatccgggggaggcagcgtgcaggctgggggatcactgagactgtcttgtgctgcctccggcgacacctacggcagctattggatgggatggtttcggcaggctcccggaaaagaacgggaaggcgtggccgccatcaacagaggcggcggatacaccgtgtacgccgactctgtgaagggcagattcacaatctccagagacacagccaagaatactgtgtacctgcagatgaactccctgcgccccgacgataccgccgactattattgcgccgcttccggcgtgctgggcggcctgcatgaggactggttcaattattggggacagggaacacttgtgacagtgtccagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2023 - DNA, 3540 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcagctcgtagaatctggaggtggttccgtgcaagccggaggatcattgcgactgacctgcgcagcgagcggatctacttctcgctcttacggtatgggatggttcagacaggctcctgggaaagagcgcgagttcgtttcaggcatctcctggaggggggacagcaccggctacgcagatagcgtgaagggcaggttcacgatcagccgagacaacgccaaaaacaccgtcgatctgcaaatgaatagtctgaagcccgaagatactgcgatctactactgtgccgccgcagcagggtccacctggtacggcacactctacgagtacgactactgggggcagggaaccctggtaaccgtgtcctctctcgagggaggaggcggctccgggggaggcggaagtggaggcggaggatctgggtctggaggaagcggatctggaggctcagggtcagggggctcaggcagtggaggctctttcgaagttcagctcgtggaaagcggtggcggaagtgtgcaggccggaggcagtttgcgcctgagctgcgctgcttccggcgatacatacgggtcttactggatgggctggtttaggcaggcacctggacaagaaagagaagctgtggccgctattaacaggggaggtggctataccgtttatgctgattccgtgaagggccgattcacaatctcccgggataacgccaaaaacactctgtacctgcagatgaactcccttaggcccgatgacacagccgattactattgtgcggcctccggcgtgctgggtggtctgcatgaggattggttcaactactgggggcaaggcaccctcgtaaccgtgagtagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2024 - DNA, 3384 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagaaacaacctggcctggtatcagcagaagcccggcaaggcccccaagcggctgatctacgccgccagcaatctccagagcggcgtgcccagcagattcacaggctctggcagcggcaccgagttcaccctgatcgtgtctagcctccagcccgaggacttcgccacctactactgcctccagcaccacagctaccccctgacatctggcggaggcaccaaggtggaaggcggaggcggaagtggaggcggaggatctggcggcggaggctctgaggtgcaggtgctggaaagtggcggaggactggtgcagcctggcggctctctgagactgtcttgtgccgccagcggcttcaccttcagcagctacgccatgagctgggtgcgccaggcccctggaaaaggactggaatgggtgtccgccatcagcggctctggcgggtctaccaactacgccgatagcgtgaagggccggttcaccatcagccgggacaacagcaagaacaccctgtacctccagatgaacagcctgcgggccgaggacaccgccgtgtattattgtgccggcagcagcgggtggagcgagtattggggacagggcaccctcgtgaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2025 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggacgagatccagctggtgcagagcggagccgaagtgaagaagcctggcgagagcctgcggatcagctgcaagggcagcggcttcaacatcgaggactactacatccactgggtgcgccagatgcccggcaagggcctggaatggatgggcagaatcgaccccgagaacgacgagactaagtacggccccatcttccagggccacgtgaccatcagcgccgacaccagcatcaacaccgtgtacctccagtggtccagcctgaaggccagcgacaccgccatgtactactgcgcctttagaggcggcgtgtactggggccagggcaccacagtgacagtgtctagcggcggaggcggaagtggaggcggaggatctggcggcggaggctctgatgtcgtgatgacccagagccccgacagcctggctgtgtctctgggagagagagccaccatcaactgcaagtccagccagtccctgctggacagcgacggcaagacctacctgaactggctccagcagaagcccggccagccccccaagagactgatctccctggtgtccaagctggactccggcgtgcccgatagattttccggctctggcagcggcaccgacttcaccctgacaatcagctcccttcaggccgaggacgtggccgtgtactattgctggcagggcacacacttccccggcacctttggcggaggcaccaaggtggaaatcaagacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2026 - DNA, 3423 bp, Artificial Sequence
  Synthetic Polynucleotide encoding a CAR with optional accessory module(s)
atggccttaccagtgaccgccttgctcctgccgctggccttgctgctccacgccgccaggccggacgagcttgtgatgacccagagccccagcagcctgacagtgacagccggcgagaaagtgaccatgagctgcaagagcagccagagcctgctgaacagcggcaaccagaagaactacctgacctggtatcagcagaagcccggccagccccccaagctgctgatctactgggccagcaccagagaaagcggcgtgcccgatagattcaccggctctggcagcggcaccgacttcaccctgacaatcagcagcgtgcaggccgaggacctggccgtgtactactgccagaacgactacagctaccccctgaccttcggagccggcaccaagctggaaatcaagggcggaggcggaagtggaggcggaggatctggcggcggaggctctgaagtgcagctgctggaacagtctggcgccgaacttgtgcggcctggcaccagcgtgaagatcagctgtaaagccagcggctacgccttcaccaactactggctgggctgggtcaagcagaggcctggacacggcctggaatggatcggcgacatctttcccggctccggcaacatccactacaacgagaagttcaagggcaaggccaccctgaccgccgacaagtctagcagcaccgcctacatgcagctgtccagcctgacctttgaggacagcgccgtgtatttctgtgcccggctgcggaactgggacgagcccatggattattggggccagggcaccaccgtgaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2027 - DNA, 3426 bp, Artificial Sequence
  Synthetic Polynucleotide encoding a CAR with optional accessory module(s)
atggccttaccagtgaccgccttgctcctgccgctggccttgctgctccacgccgccaggccggacgagctgcagatgacccagagccctagcagcctgtctgccagcgtgggcgacagagtgaccatcacctgtagagccagccagagcatcagcagctacctgaactggtatcagcagaagcccggccagccccccaaactgctgatctactgggccagcaccagagaaagcggcgtgcccgatagattcagcggcagcgagagcggcaccaactacaccctgaccatcagctccctgcagcccgaggacttcgccacctacttttgccagcagagcgacagcctgcccatcacctttggacagggcacccggctggacattcagggcggaggcggaagtggaggcggaggatctggcggcggaggctctgaggtgcaactgctggaatctgggggcggagtggtgcagcctggcagaagcctgagactgagctgtgccgccagcggcttcaccttcagctcctacggaatgcactgggtgcgccaggcccctggcaaaggactggaatgggtggccgtgatctcctacgacggcagcaacaagtactacgccgacagcgtgaagggccggttcaccatcagccgggacaacagcaagaacaccctgtacctgcagatgaacagcctgcgggccgaggacaccgccgtgtactactgcgccaaggatatgggctggggcagcggctggcggccttactactactacggcatggacgtgtggggccagggcaccaccgtgacagtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2028 - DNA, 3417 bp, Artificial Sequence
  Synthetic Polynucleotide encoding a CAR with optional accessory module(s)
atggccttaccagtgaccgccttgctcctgccgctggccttgctgctccacgccgccaggccggacgacatccaaatgacacagagtccttctagtttgagtgcgagcgtgggggacagggtgaccattacctgcagggccagccagagcataagctcataccttaattggtaccagcaaaaaccaggtaaggcccctaagctcctgatctacgcggcctcttcacttcaatctggggtcccttcccgcttcagtggctccggcagcggcaccgacttcacgctcactatatcaagtctgcagcctgaggatctcgccacctattactgtcaacaaagttattccacccctttcacctttggaccgggcacgaaagtggatattaagggcggaggcggaagtggaggcggaggatctggcggcggaggctctgtgcacgaggtccagcttgtgcagtccggggcagaggtcaagaagcctggttctagcgtaaaagtgagttgcaaagcctcaggtgggacattttcatcctacgcgatcagttgggttagacaggctcctggtcaagggctggaatggatgggcggaattattccaatcttcggaacagcgaattacgcgcagaagttccagggtagagtaaccatcactgctgacaagtccacctccaccgcatacatggaattgtctagtctccggagcgaggatacggcggtgtattattgtgctacgttcgccctgtttggcttccgcgaacaggctttcgacatctgggggcagggcacgacagtcacggttagtagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2029 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagacccctctgagcctgcctgtgtccctgggcgatcaggccagcatctcctgtagaagcagccagagcctggtgcacagcaacggcaacacctacctgcggtggtatctccagaagcccggccagagccccaaggtgctgatctacaaggtgtccaacagattcagcggcgtgcccgacagattctccggcagcggctctggcaccgacttcaccctgaagatcagccgggtggaagccgaggacctgggcgtgtacttctgtagccagagcacccacgtgccctggacctttggcggcggaacaaagctggaaatcaagggcggaggcggaagtggaggcggaggatctggcggcggaggctctgaagtgaagctggacgagacaggcggagggctggtgcagcctggcagacctatgaagctgagctgtgtggcctccggcttcaccttcagcgactactggatgaactgggtgcgccagtcccccgagaagggcctggaatgggtggcccagatcagaaacaagccctacaactacgaaacctactacagcgacagcgtgaagggccggttcaccatcagcagggacgacagcaagagcagcgtgtacctccagatgaacaacctgagggtggaagatatgggcatctactactgcaccggcagctactacggcatggactactggggccagggcaccagcgtgaccgtgtctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2030 - DNA, 3441 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagagcagcgccgacgacgccaagaaggacgccgccaaaaaggatgatgccaagaaagacgatgctaaaaaagacggcggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2031 - DNA, 3429 bp, Artificial Sequence
  Synthetic Polynucleotide encoding a CAR with optional accessory module(s)
atggccttaccagtgaccgccttgctcctgccgctggccttgctgctccacgccgccaggccgcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctggcggaggcggaagtggaggcggaggatctggcggcggaggctcttctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2032 - DNA, 3414 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagaaccagccagagcctgagcagctacacccactggtatcagcagaagcctggcaaggcccctaagctgctgatctatgccgcttccagcagaggcagcggagtgcctagcagattttctggcagcggctccggcaccgatttcaccctgacaatatccagcctccagcctgaggacttcgccacctactactgccagcagagcagaacattcggccagggcaccaaggtggaaatcaaaggcggaggcggaagtggaggcggaggatctggcggcggaggctctcaagttcagctccagcagtctggccctggcctggttaagcctagccagacactgagcctgacctgtgccatcagcggcgatagcgtgtccagctacaacgccgtgtggaactggatcagacagagcccatccagaggactggaatggctgggcagaacctactacagaagcggctggtacaacgactacgccgagagcgtgaagtcccggatcaccatcaatcccgacaccagcaagaaccagttcagcctgcaactgaacagcgtgacccctgaggataccgccgtgtactactgtgctagaagcggccacatcaccgtgttcggcgtgaacgtggacgccttcgatatgtggggccagggaacaatggtcaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2033 - DNA, 3411 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacccagagccctctgagcctggccgtgtctctgggacagcctgccatcatcagctgcaaggccagccagagcgtgtcctttgccggcacctctctgatgcactggtatcaccagaagcccggccagcagcccagactgctgatctacagagccagcaacctggaagccggcgtgcccgatagattttccggcagcggcagcaagaccgacttcaccctgaccatcagccccgtggaagccgaagatgccgccacctactactgccagcagagcagagagtacccctacaccttcggcggaggcaccaagctggaaatcaagaggggcggaggcggaagtggaggcggaggatctggcggcggaggctctcaggtccaactggtgcagagcggagccgaggtcgtgaagcctggcgcttccgtgaagattagctgcaaagccagcggctacacctttaccggctactttatgaactgggtcaagcagagccctggccagagcctggaatggatcggcagaatccacccctacgacggcgacaccttctacaaccagaagttccagggcaaggccaccctgacagtggacaagagcagcaacaccgcccacatggaactgctgagcctgaccagcgaggacttcgccgtgtactactgcaccagatacgacggcagccgggctatggactattggggccagggcaccaccgtgaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2034 - DNA, 3330 bp, Artificial Sequence
  Synthetic Polynucleotide encoding a CAR with optional accessory module(s)
atggccttaccagtgaccgccttgctcctgccgctggccttgctgctccacgccgccaggccgaacagctgcgagctgaccaacatcacaatcgccatcgagaaagaggaatgccggttctgcatcagcatcaacaccacttggtgcgccggctactgctacacccgcgatctggtgtataaggaccccgccagacctaagatccagaaaacctgcaccttcaaagagctggtctacgagacagtcagagtgcctggatgtgcccaccacgccgatagcctgtacacataccctgtggctacccagtgccactgcggcaagtgtgatagcgacagcaccgattgcaccgtcagaggactgggacccagctactgtagcttcggcgagatgaaggaaggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2035 - DNA, 3423 bp, Artificial Sequence
  Synthetic Polynucleotide encoding a CAR with optional accessory module(s)
atggccttaccagtgaccgccttgctcctgccgctggccttgctgctccacgccgccaggccggacctggaaaccaccctgacacagagccctgccaccctgagtgtgtccccaggcgagagagtgaccctgagctgtagagccagccagagcgtgggcagcaacctggcctggtatcagcagaagttcggccaggcccccagactgctgatctacgacgccagcacaagagccaccggcatccccgccagattttctggcagcggctccggcaccgagttcaccctgaccatcagcagactggaacccgaggacttcgccgtgtactactgccaccagtacggcagcagccccagaacctttggacagggcaccaaggtggacatcaagcggggcggaggcggaagtggaggcggaggatctggcggcggaggctctcaggtgcaactggtgcagagcggagccgaagtgaagaaacctggggccagcgtgaaggtgtcctgcaaggccagcggctacacctttaccacctacggcatctcttgggtgcgccaggctcctggacagggactggaatggatgggctggatcagcgcctacaacggccacaccaactacgcccagatgctccagggcagagtgaccatgaccaccgacaccagcacctccaccgcctacatggaactgcggggcctgagaagcgacgacaccgccgtgtattattgcgccagagaagcctacgcctcctacggcagcggcagctactggaccgattattggggccagggcaccctcgtgaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2036 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggacgacgttgtgatgacccagacccccctgagcctgcctgtgacacctggcgaacctgccagcatcagctgtcggagcagccagagcctggtgcacagaaacggcaacacctacctgcactggtatctccagaagcccggccagagccccaagctgctgatccacaaggtgtccaacagattcagcggcgtgcccgacagattctccggcagcggctctggcaccgacttcaccctgaagatcagccgggtggaagccgaggacctgggcgtgtacttctgtagccagagcacccatgtgccccccctgacatttggagccggcaccaagctggaactgaagggcggaggcggaagtggaggcggaggatctggcggcggaggctctgaagtgcagctggtgcagtctggcgctgaggtggaaaagcctggggccagcgtgaagattagctgcaaggccagcggcagcagcttcaccggctacaacatgaactgggtgcgccagaacatcggcaagagcctggaatggatcggagccatcgacccctactacggcggcaccagctacaaccagaagttcaagggcagagccaccctgaccgtggacaagagcaccagcaccgcctacatgcacctgaagtccctgcggagcgaggacaccgccgtgtactactgtgtgtccggcatggaatattggggccagggcaccagcgtgaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2037 - DNA, 3396 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgatgacccagacccctgccaccctgtctgtgtctgccggcgagagagtgaccattacctgcaaggccagccagagcgtgtccaacgacgtgacctggtatcagcagaagcccggccaggcccccagactgctgatctacagcgccagcaacagatacagcggcgtgcccgccagattttccggcagcggctacggcaccgagttcaccttcaccatcagcagcgtgcagagcgaggacttcgccgtgtacttctgtcagcaagactacagcagcttcggccagggcaccaagctggaaatcaagaggggcggaggcggaagtggaggcggaggatctggcggcggaggctctcaggtgcagctggtggaatctggacctggcgtggtgcagcctggcagaagcctgagaatcagctgtgccgtgtccggcttcagcgtgaccaactacggcgtgcactgggtgcgccagccacctggaaaaggactggaatggctgggcgtgatctgggctggcggcatcaccaactacaacagcgccttcatgtcccggctgaccatctccaaggacaacagcaagaacaccgtgtacctccagatgaacagcctgcgggccgaggacaccgccatgtactactgtgcttccagaggcggccactacggctacgccctggattattggggccagggaaccctcgtgaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2038 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagaccgccagcagcctgcctgcctctctgggcgacagagtgaccatctcctgtagcgccagccaggacatcagcaactacctgaactggtatcagcagaaacccgacggcaccgtgaagctgctgatcttctacagcagcaacctgcacagcggcgtgcccagcagattttctggcggcggaagcggcaccgactacagcctgaccatcagcaatctggaacccgaggacattgccacctacttttgccaccagtacagcaagctgccctggacctttggcggaggcaccaagctggaaatcaagagaggcggaggcggaagtggaggcggaggatctggcggcggaggctctgaagtgaccctggtggaaagcggcggagacttcgtgaagcctggcggctctctgaaggtgtcctgtgccgccagcggcttcgcctttagccactacgccatgagctgggtgcgccagacccctgccaagagactggaatgggtggcctacatcagcagcggcggctccggcacctactactccgatagcgtgaagggccggttcaccatcagccgggacaacgccaagaacaccctgtacctccagatgcggagcctgcggagcgaggacagcgccatgtatttctgcaccagagtgaagctgggcacctattacttcgactcttggggccagggcaccaccctgaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2039 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccgcagttcgtgctgacccagagcccttctgcctctgctgccctgggagcctctgccaagctgacctgtacactgagcagcgcccacaagacctacaccatcgactggtatcagcagcagaagggaaaggcccccagatacctgatccaagtgaagtccgacggcacctacacaaaggccaccggcgtgcccgatagattcagcggcagtagcagcggagccgatagatacctgattatccccagcgtgcaggccgacgacgaggccgattactactgcggcaccgattacaccggcggctacgtgttcggcggaggcacacaactgaccgtgacaggcggaggcggaagtggaggcggaggatctggcggcggaggctctgagcaactgaaagagtctggcggcggactgttcaagcccaccgataccctgaccctgacctgcaccgtgtccggcttcagcctgagctactacggcgtgaactgggtgcgccaggcccctggcaatggcctggaatggatcggcacaatcggcggcagcggcgacacctactatgcctcttgggccaagtccagaagcaccatcatcagaaacaccaacgagaacaccgtgaccctgaagatgaccagcctgacagccgccgacaccgccacctacttttgcgtcagatacgccaacatcggctacgagtatttcaacgtgtggggacccggcaccctcgtgaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2040 - DNA, 3423 bp, Artificial Sequence
  Synthetic Polynucleotide encoding a CAR with optional accessory module(s)
atggccttaccagtgaccgccttgctcctgccgctggccttgctgctccacgccgccaggccgcagttcgtgctgacccagagcccttctgtgtctgccgccctgggagcctctgccaagctgacctgtacactgagcagcgcccacaagacctacaccatcgactggtatcagcagcagcagggcgaggcccccagatacctgatgcaagtgaagtccgacggcagctacaccaagggcaccggcgtgcccgatagattcagcggcagtagcagcggagccgatagatacctgattatccccagcgtgcaggccgacgacgaggccggatatgtgtgcggcgctgacgacaatggcggctacgtgttcggcggaggcacccaactgacagtgacaggcggaggcggaagtggaggcggaggatctggcggcggaggctctcagagcgtgaaagagtctgagggcggcctgttcaagcccaccgataccctgaccctgacctgcaccgtgtccggcttcagcctgagcagacacgccctgacatgggtgcgccaggcccctggaaatggcctggaatggatcggagccatcgacaacgccggcaccacctactatgcctcttgggccaagtccagaagcaccatcacccggaacaccgacctgcacaccgtgaccctgaagatgaccagcctgaccgccagcgacaccgccacctacttttgcgccagagtgttctacgacatcaacagcggctactacctggacggcatggacctgtggggacctggcacacttgtgaccgtgtccagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2041 - DNA, 3405 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctacccccccacctttggcggaggcaccaaggtggaaatcaagggcggaggcggaagtggaggcggaggatctggcggcggaggctctgaagtgcaactggtggaatcaggcggcggactggtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacttcggcatggacgtgtggggccacggcaccaccgtgacagtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2042 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtggaatccgggggaggctctgtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacgacttcggcatggacgtgtggggccagggcacaaccgtgacagtgtctagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2043 - DNA, 3405 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctccatctgcctctggcacacctggacagagagtgaccatcagctgtagcggcagcagaagcaacgtcggcggcaactacgtgttctggtatcagcaggtcccaggcgctacccctaagctgctgatctacagaagcaatcagcggcctagcggcgtgcccgatagatttgccggaagcaagagcggcagctctgccagccttgccatctctggactgagaagcgaggacgaggccgactactactgtgccacctgggatgatagcctgagcggcttcgtgtttggcaccggcaccaaagtgacagtgcttggtggcggaggcggaagtggaggcggaggatctggcggcggaggctctgaagttcagctggttgaatctggcggcggactggttaagcctggcggatctctgagactgtcttgtgccgccagcggcttcaccttcagcgattactacatgagctggatcagacaggcccctggcaaaggactggaatgggtgtcctacatcagcagcagcggctccaccatctactacgccgatagcgtgaagggcagattcaccatcagccgggacaacgccaagaacagcctgtacctccagatgaactccctgagagccgaggacaccgccgtgtactattgcgccagaggctacggcaaagcctacgatcaatggggccagggcacactggtcaccgtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2044 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggtcacacagccacctagcatgtctgccgctccaggccagcaagtgaccatctcttgtagcggcggcaacagcaacatcgagcggaactacgtgtcctggtatctgcaactgcctggcacagcccctaagctggtcatcttcgacaacgacagacggcccagcggcatccccgatagattttctggcagcaagagcggcaccagcgccacactgggaattaccggacttcagacaggcgacgaggccgactactactgtggcacatgggactctagcctgagaggctgggttttcggcggaggcacaaagctgacagtgcttggtggcggaggcggaagtggaggcggaggatctggcggcggaggctctgaagtgcagctcgttgagtctggcggcggactgattcaacctggcggaagcctgagactgagctgtgccgcttccggcttcaccttcagcaactacgccatgaactgggttcgacaggcccctggcaaaggactggaatgggtgtccaccatcaacggcagaggcagcagcaccatctacgccgattctgtgaagggcagattcaccatcagccgggacaacagcaagaacaccctgtacctccagatgaactccctgagagccgaggacaccgccacctattactgtgcccggtacatcagcagaggactgggcgattcttggggccagggcacactggttacagtgacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2045 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggtcacacagcctccatctgtgtctggcgctccaggccagagagtgaccatctcttgtaccggcagcagcagcaatatcggagccggctatgacgtgcactggtatcagcagctccctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggcagctatgtgtttggcaccggcaccaagctgacagtgcttggaggcggaggcggaagtggaggcggaggatctggcggcggaggctctgaagttcaactggtggaaaccggcggcaacctggttcaacctggcgcttctctgagactgagctgtgccgccagcggctttagctttagcggaacagccatgcactgggtccgacaggcacctggcaaaggactggaatgggtgtccaccatcagcagcacaggcagaagcacctactaccgggacagcgtgaagggcagattcaccatctccagagacaacagcaagaacaccctgtacctccagatgaacagcctgagaggcgaggacaccgccgtgtactattgtgccagagtgtccttcgactactggggccagggaaccctggtcacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2046 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggttacacagcctgcctccgtgtctggctctcctggccagagcatcaccatcagctgtaccggcaccagctctgatgtcggcggctacaattacgtgtcctggtatcagcagcaccccggcaaggcccctaagctgatgatctacgacgtgtccaagaggcccagcggcgtgtccaatagattcagcggcagcaagagcggcaacaccgccagcctgacaatttctggactgcaagccgaggacgaggccgactactactgtagcagctacaccagcagcagcacactggtgtttggcggaggcaccaagctgacagttcttggaggcggaggcggaagtggaggcggaggatctggcggcggaggctctgaagttcagctggttgaaagcggcggagcctttgttcagcctggcggatctctgagactgagctgtgccgccagcggcttcacattttccagctacgccatgacctgggtccgacaggctcctggcaaaggactggaatgggtgtccaccatctccggcagaggcagaagcaccttctacgccgatagcgtgaagggcagattcacaatcagccgggacaacagcaagaacaccctgtacctccagatgaacagcctgagagccgaggataccgccgtgtactactgtgcccggtactatcacgctggcgcctttgatctttggggccagggaacactggtcaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2047 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggacaacatcgagctgacccagagccccgccatcatgagtgcctctccaggcgagcgcgtgaccatgacatgtagcgccagcagcagcatccggtacatctactggtatcagcagaagcccggcagcagccccagactgctgatctacgacaccagcaacgtggcccctggcgtgccctttagattttccggcagcggctccggcaccagctacagcctgaccatcaaccggatggaagccgaggacgccgccacctactattgtcaggaatggagcggctacccctacaccttcggcggaggcaccaagctggacatcaagagaggcggaggcggaagtggaggcggaggatctggcggcggaggctctcaagtgaagctccaggaatctggcggcggactcgtgaagcctggcggctctctgaagctgagctgtgccgccagcggcttcaccttcagcagctacggcatgagctgggtgcgccagacccccgacaagagactggaatgggtggcaaccatcagcagcggcggcagctacacctactaccccgatagcgtgaagggccggttcaccatctccagagacaacgccaagaacaccctgtacctccagatgagcagcctgaagtccgaggataccgccatgtactactgcgccagaggcaactgggagggctggtacttcgatgtgtggggccagggcaccaccgtgaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2048 - DNA, 3432 bp, Artificial Sequence
  Synthetic Polynucleotide encoding a CAR with optional accessory module(s)
atggccttaccagtgaccgccttgctcctgccgctggccttgctgctccacgccgccaggccggacaacttcatgctgacccagccccacagcgtgtccgagagccctggcaagaccgtgaccatctcctgtaccggcagcggcggcagcatcgacaacaactacgtgcactggtatcagcagaggcccggcagcgcccctaccaccgtgatgttcgaggacaaccagaggcccagcggcgtgcccgatagattcagcggctctatcgacagcagcagcaacagcgccagcctcgtgatctccggcctgaaaaccgaggacgagggcgactactactgccagagcagcgacggctccaaggtggtgtttggcggaggcaccaagctgaccgtgctgggacagggcggaggcggaagtggaggcggaggatctggcggcggaggctctgaagtgcaactggtgcagagcggcggaggctctctgacactgtcttgtgctgcctccggcgtggtgcagcctggcagattcaccttcagcagctacggaatgcactgggtgcgccaggcccctggaaagggactggaatgggtgtccgtgatctcttacgacggcagcaacaagtattacgccgacagcgtgaagggccggttcaccatctccagagacaacagcaagaacaccctgtacctccagatgaacagcctgcggaccgaggacaccgccgtgtactactgtgccaagaccctgtccgctggcgagtggattggaggcggagccttcgatatctggggccacggcacaatggtcaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2049 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagacccctctgagcctgcctgtgtccctgggcgatcaggccagcatcagctgtagaagcagccagagcctggtgcacagcaacggcaacacctacctgcactggtatctccagaagcccggccagagccccaagctgctgatctacaaggtgtccaacagattcagcggcgtgcccgacagattctccggcagcggctctggcaccgacttcaccctgaagatcagccgggtggaagccgaggacctgggcgtgtacttctgtagccagaacacccccgtgccccccaagtttggcagcggcaccaagctggaaatcaagggcggaggcggaagtggaggcggaggatctggcggcggaggctctcaggtgcagctccagcagtctggcgctgaactcgtgcggcctggcgcttctgtgaagctgtcttgcaaggccagcggctacaccttcaacgactacgagatgcactgggtcaagcagacccctgtgcacggcctgaagtggatcggagccctggaacccaagaccggcgataccgcctacagccagaagttcaagggcaaggccaccctgaccgccgacaagagcagcagcacagcctacatggaactgcggagcctgaccagcgaggacagcgccgtgtactactgcaccagctgctactactacacctacagcggccagggcaccctcgtgacagtgtctgctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2050 - DNA, 3399 bp, Artificial Sequence
  Synthetic Polynucleotide encoding a CAR with optional accessory module(s)
atggccttaccagtgaccgccttgctcctgccgctggccttgctgctccacgccgccaggccggacatccaactgacccagagccccagcagcctgtctgcctctgtgggcgacagagtgaccatcacctgtagagccagccagggcatcagaaacgacctgggctggtatcagcagaagcccggcaaggcccccaagcggctgatctatgctgccagctccctccagaatggcgtgcccagcagattttccggcagcggctctggcaccgagttcaccctgaccatcagctccctccagcccgaggacttcgccacctactactgcctccagcacaacacctaccccgccttcggccagggcaccaaggtggaaatcaagagaggcggaggcggaagtggaggcggaggatctggcggcggaggctctcaggtgcaactccaggaatctggccctggcctcgtgaagcctagccagaccctgagcctgacctgtaccgtgtctggcggcagcatcagcagcttcaactactactggtcctggatcagacaccaccctggcaagggcctggaatggatcggctacatctactacagcggcagcacctacagcaaccccagcctgaagtcccgcgtgaccatctccgtggacaccagcaagaaccagtttagcctgaccctgtccagcgtgacagccgccgataccgccgtgtactactgcgccagaggctacaactggaactacttcgactactggggccagggaaccctcgtgaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2051 - DNA, 3405 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgctgacccagagccccgccagcctggccgtgagcctgggccagagcgtgaccatcagctgcagagccagcgagagcgtggagtactacggcaccagcctgatgcagtggtaccagcagaagcccggccagccccccaagctgctgatctacgccaccagcaacgtggagagcggcgtgcccgccagattcagcggcagcggcagcggcaccgacttcagcctgaacatccaccccgtggaggaggacgacatcgccatgtacttctgccagcagagcagaaagctgcccagcaccttcggcggcggcaccaagctggagatcaagggcggaggcggaagtggaggcggaggatctggcggcggaggctctgacgtgagactgcaggagagcggccccggccaggtgaagcccagccagaccgtgagcctgacctgcagcgtgaccggctacagcatcaccaacggcaaccactggtggaactggatcagacaggtgagcggcagcaagctggagtggatcggctacatcagcagcagcggcagcaccgacagcaaccccagcctgaagagcagaatcagcatcaccagagacaccagcaagaaccagctgttcctgcagctgaacagcgtgaccaccgaggacatcgccacctactactgcgccagaggctactacttcgactactggggccagggcaccaccctgaccgtgagcagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2052 - DNA, 3039 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcaactggtggaaagcggcggaggcctggtgcaggctggcggatctctgagactgagctgtgccgccagcggcatcaccttcagcatcaacacaatgggctggtacagacaggcccctggcaagcagagggaactggtggccctgatctccagcatcggcgacacctactacgccgacagcgtgaagggccggttcaccatcagccgggacaacgccaagaacaccgtgtacctccagatgaacagcctgaagcccgaggacaccgccgtgtactactgcaagcggttcagaacagccgcccagggcaccgattattggggccagggaacacaagtgaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2053 - DNA, 2844 bp, Artificial Sequence
  Synthetic Polynucleotide encoding a CAR with optional accessory module(s)
atggactggatttggcgcatccttttccttgtcggcgctgctaccggcgcccattccttcgaaggcagcggattcgaatacgccaaagagatgcggaacgcctactgggagatcgccctgctgcccaatctgaccaaccagcagaagagagcccccatcagaaagctgtacgacgacccctcccagagcagcgagctgctgtctgaggctaaaaaactgaacgatagccagacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2054 - DNA, 3057 bp, Artificial Sequence
  Synthetic Polynucleotide encoding a CAR with optional accessory module(s)
atggccctgcccgtgacagccctgctgctgcctctggctctgctgctgcacgccgccagacccgatgaattcggctctgacctgggcatcaagctgctgttcgccgctgccaagggccaggacgacgaagtgcggattctgctggctgctggggccgacgtgaacgccaaggatttcgagggctacacccccctgcacgtggccgcctatgatggacacctggaaatcgtggaagtgctgctgaaggctggcgctgatgtgaatgccaaagacagccagggccggacccctctgcatgaagccgcctacagcggccatctggaaattgtggaagtgctgctgaaagccggggcagacgtgaacgctcaggacgacgctggcgagacaccagccgatctggctgcagcttggggccacgaagatatcgccgaggtgctgcagaagacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2055 - DNA, 3054 bp, Artificial Sequence
  Synthetic Polynucleotide encoding a CAR with optional accessory module(s)
atggactggatttggcgcatccttttccttgtcggcgctgctaccggcgcccattccttcgaaagaagcgatctgggaaagaagctgctggaagctgccagagccggacaggatgatgaagtgcgcatcctgatggcaaacggcgcagatgtgaacgcaaaggacgagtacggcctgacccccctgtacctggctacagcccacgggcacctggaaattgtggaagtgctgctgaagaacggcgctgacgtgaacgccgtggacgccatcggctttaccccactgcatctggccgctttcatcgggcatctcgaaatcgcagaggtgctgctgaaacacggggccgatgtgaatgcccaggacaagttcggcaagaccgccttcgacatcagcatcggcaacggcaacgaggacctggccgagatcctgcagaaactgaacacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2056 - DNA, 3510 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcaactggtggaaagcggcggaggcctggtgcaggctggcggatctctgagactgagctgtgccgccagcggcatcaccttcagcatcaacacaatgggctggtacagacaggcccctggcaagcagagggaactggtggccctgatctccagcatcggcgacacctactacgccgacagcgtgaagggccggttcaccatcagccgggacaacgccaagaacaccgtgtacctccagatgaacagcctgaagcccgaggacaccgccgtgtactactgcaagcggttcagaacagccgcccagggcaccgattattggggccagggaacacaagtgaccgtgtcctctctcgagggaggaggcggctccgggggaggcggaagtggaggcggaggatctgggtctggaggaagcggatctggaggctcagggtcagggggctcaggcagtggaggctctttcgaagtgcaactggtggaatctgggggcggactggtgcagccaggcggaagtctgaggctgtcttgtgccgcctccggcagcatcttcggcttcaacgacatggcctggtatcggcaggctcccggaaaacagcgcgagctggtggctctgattagcagagtgggcgtgaccagcagcgccgactctgtgaagggcagattcacaatctccagagtgaacgccaaggatacagtgtacctccagatgaactctctgaaacctgaggatacagcagtgtactattgctacatggaccagcggctggacggcagcacactggcctactggggacagggaactcaagtgacagtgtctagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2057 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccaggacgtgaacaccgccgtggcctggtatcagcagaagcctggcaaggcccccaagctgctgatctacagcgccagcttcctggaaagcggcgtgcccagcagattcagcggaagcagaagcggcaccgacttcaccctgaccatcagctccctccagcccgaggacttcgccacctactactgccagcagcactacaccacccctcccaccttcggccagaccaaggtggaaatcaagagaggcggaggcggaagtggaggcggaggatctggcggcggaggctctgaagtgcaactggtggaatctggcggcggactggtgcagcctggcggatctctgagactgagctgtgccgccagcggcttcaacatcaaggacacctacatccactgggtgcgccaggcccctggaaagggactggaatgggtggcccggatctaccccaccaacggctacaccagatacgccgacagcgtgaagggccggttcaccatcagcgccgacaccagcaagaataccgcctacctccagatgaacagcctgcgggccgaggataccgccgtgtactactgctcaagatggggaggcgacggcttctacgctatggacgtgtggggccagggcacccttgtgaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2058 - DNA, 3039 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgacgtgcaactcgtggaatccggcggaggcctggtgcagcctggcggatctctgagactgagctgtgccgccagcggctctatcggcggactgaatgccatggcctggtacagacaggcccctggcaaagaacgggaactggtggccggcatctttggcgtgggcagcaccagatacgccgacagcgtgaagggccggttcaccatcagccgggacaacagcaagaacaccgtgtacctgcagatgaacagcctgcggcccgaggataccgccgtgtactactgcagaatgtccagcgtgaccagaggctccagcgactactggggccagggaacacttgtgaccgtgtccagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2059 - DNA, 2859 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgtggacaacaagttcaacaaagagcggtacagcgcctactacgagatttggcaactgcccaacctgaacgtgcggcagaaggccgccttcatcggatctctgcaggacgaccctagccagagcgccaatctgctggccgaggccaagaagctgaacgacgcccaggcccctaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2060 - DNA, 3525 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgacgtgcaactcgtggaatccggcggaggcctggtgcagcctggcggatctctgagactgagctgtgccgccagcggctctatcggcggactgaatgccatggcctggtacagacaggcccctggcaaagaacgggaactggtggccggcatctttggcgtgggcagcaccagatacgccgacagcgtgaagggccggttcaccatcagccgggacaacagcaagaacaccgtgtacctgcagatgaacagcctgcggcccgaggataccgccgtgtactactgcagaatgtccagcgtgaccagaggctccagcgactactggggccagggaacacttgtgaccgtgtccagtctcgagggaggaggcggctccgggggaggcggaagtggaggcggaggatctgggtctggaggaagcggatctggaggctcagggtcagggggctcaggcagtggaggctctttcgaagtgcaactggtggaatctggaggctctctggtgcagccagggggaagcctgagactgtcttgtgccgcttccggcttcaccttcgacgactacgccatgagctgggtgcgccaggtgccaggcaaaggcctggaatgggtgtccagcatcaactggagcggcacccacaccgattacgccgactccgtgaaaggcagattcacaatcagcagaaacaacgccaacaataccctgtacctgcagatgaactccctgaagtctgaggatacagcagtgtattattgcgccaagaactggcgggacgccggcaccacttggtttgagaaaagcggctctgccggacagggaacccaagtgacagtgtcctccacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2061 - DNA, 3399 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtgctgacacagcctcctagcgtgtcagtggcccctggcaagaccgccagaatcccctgcgagggcaactacatcggcagcagcaacgtgcactggtatcagcagaagcccggccaggctcccgtgctcgtgatccacttcgacagcgacagacccagcggcatccccgacagattcagcggcagcaacagcggcaacatggctaccctgaccatcagcagagtggaagccggggacgaggccgactactactgtcaagtgtgggagaaccacggctgggtgttcggcggaggcaccaagctgacagtgctgtctggcggaggcggaagtggaggcggaggatctggcggcggaggctctgaggtgcaactggtggaaacaggcggcggactggtgcagcctggcgagtctctgagactgagctgtgccgccagcggcttcaccttcagcgactacgagatgaactgggtgcgccaggcccctggaaagggcctggaatgggtgtcctacatcagcagctccggcagcaccatctactacgccgacagcgtgaagggccggtttaccatctaccgggacaacgccaagaacagcctgtacctccagatgaactccctgcgggccgaggacaccgccctgtactattgtgccagagcctggggcgtgggaccccctgattattggggacagggcaccctcgtgaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2062 - DNA, 3423 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgataccgtgaccatcacctgtcaggccaacggctacctgaactggtatcagcagcggagaggcaaggcccccaagctgctgatctacgacggcagcaagctggaaagaggcgtgcccagcagattcagcggcagaagatggggccaggagtacaacctgaccatcaacaacctccagcccgaggatattgccacatacttttgccaggtgtacgagttcgtggtgcccggcacacggctggacctgaagagaacagtggctgctcctggcggaggcggaagtggaggcggaggatctggcggcggaggctctcaggtgcagctgctccagtctggcgctgccgtgacaaagcctggcgcttctgtgcgggtgtcctgtgaagccagcggctacaacatccgggactacttcatccactggtggcggcaggctccaggccagggactccagtgggtgggatggatcaaccccaagaccggccagcccaacaaccccagacagttccagggcagagtgtccctgaccagacacgccagctgggacttcgacaccttcagcttctacatggatctgaaggccctgcggagcgacgataccgccgtgtacttctgcgccagacagagaagcgactactgggatttcgacgtgtggggcagcggcacccaagtgacagtgtctagcgccagcaccaagggacccacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2063 - DNA, 3441 bp, Artificial Sequence
  Synthetic Polynucleotide encoding a CAR with optional accessory module(s)
atggccttaccagtgaccgccttgctcctgccgctggccttgctgctccacgccgccaggccgcagtctgccctgacacagcctcctagcgcctctggctctcccggccagagcatcaccatcagctgtaccggcaccagcaacaacttcgtgtcctggtatcagcagcacgccggcaaggcccccaagctcgtgatctacgacgtgaacaagcggcccagcggcgtgcccgatagattcagcggcagcaagagcggcaacaccgccagcctgacagtgtctggcctccagaccgatgacgaggccgtgtactactgcggcagcctcgtgggcaactgggacgtgatctttggcggaggcaccaagctgaccgtgctgggcggaggcggaagtggaggcggaggatctggcggcggaggctctcagccccagctccaggaatctggccccacactggtggaagccagcgagacactgagcctgacctgtgccgtgtccggcgattctaccgccgcctgcaatagcttctggggctgggtgcgccagcctcctggaaagggactggaatgggtgggaagcctgagccactgcgccagctattggaaccggggctggacctaccacaaccccagcctgaagtccagactgaccctggccctggacacccccaagaacctggtgttcctgaagctgaacagcgtgacagccgccgacaccgccacctactactgtgccagatttggcggcgaggtgctgcggtacaccgactggcctaaacctgcctgggtggacctgtggggcagaggaacactcgtgaccgtgtccagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2064 - DNA, 3396 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgagacagccatcatcagctgccggacaagccagtacggcagcctggcctggtatcagcagaggccaggacaggcccccagactcgtgatctacagcggcagcacaagagccgccggaatccccgatagattcagcggctccagatggggacccgactacaacctgaccatcagcaacctggaaagcggcgacttcggcgtgtactactgccagcagtacgagttcttcggccagggcaccaaggtgcaggtggacatcaaaagaggcggaggcggaagtggaggcggaggatctggcggcggaggctctcaggtgcagctggtgcagtctggcggccagatgaagaaacccggcgagagcatgagaatcagctgtcgggcctccggctacgagttcatcgactgcaccctgaactggatcagactggcccctggcaagcggcctgagtggatgggatggctgaagcctagaggcggagccgtgaactacgccagacctctccagggcagagtgaccatgaccagggacgtgtacagcgataccgccttcctggaactgcggagcctgaccgtggatgataccgccgtgtacttctgcaccagaggcaagaactgcgattacaactgggacttcgagcactggggcagaggcacccctgtgatcgtgtctagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2065 - DNA, 3426 bp, Artificial Sequence
  Synthetic Polynucleotide encoding a CAR with optional accessory module(s)
atggccttaccagtgaccgccttgctcctgccgctggccttgctgctccacgccgccaggccggagctggtgctgacacagagccctggcaccctgtctctgtctgccggcgaaagagccaccctgagctgtagagccagccagagcgtgtcctctggcagcctggcttggtatcagcagaagccaggccaggcccccagactgctgatctacggcgcttctaccagagccaccggcatccccgatagattcagcggctctggctccggcaccgacttcaccctgacaatcggcagactggaacccgaggacctggccgtgtactactgccagcagtacggcaccagcccctacacattcggccagggcaccaagctggaaatcggcggaggcggaagtggaggcggaggatctggcggcggaggctctctggaacagagcggagccgaagtgaagaaacccggcagcagcgtgcaggtgtcctgcaaagcaagcggcggcaccttctctatgtacggcttcaactgggtgcgccaggctcctggacacggcctggaatggatgggcggcatcatccccatcttcggcacctccaactacgcccagaaattccggggcagagtgaccttcaccgccgaccaggccacaagcaccgcctacatggaactgaccaacctgcggagcgacgacaccgccgtgtattattgcgccagagacttcggccccgactgggaggatggcgacagctacgatggcagcggcagaggcttcttcgacttctggggccagggaacccttgtgaccgtgtcctcaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2066 - DNA, 3414 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgacaatcacctgtcagagcagcctggacatcagccactacctgaactggtatcagcagaagcccggcaaggcccctaagctgctgatctacgacgccagcaatctggaaaccggcgtgcccagcagattttctggcagcggaagcggcacccacttcaccttcacaatatccagcctccagcctgaggacttcgccacctactactgccagcagtacgacaacctgcctctgacctttggcggaggcaccaagctggaaatcaagagaggcggaggcggaagtggaggcggaggatctggcggcggaggctctcaagttcaactggttcaatcaggcggaggcgtggtgcaacctggtggctctctgagagtgtcttgtgctgcctctggcgtgaccctgagcgactatggaatgcactgggtccgacaggcccctggcaaaggacttgagtgggtcgccttcatcagaaacgacggcagcgacaagtattacgccgacagcgtgaagggcagattcaccatcagccgggacaacagcgagaaaaccgtgtctctccagatgtctagcctgagagccgaggacaccgccgtgtactactgtgccaagaatggcgagagcggccctctggactactggtatctggatctgtggggcagaggcaccctggtcacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2067 - DNA, 3414 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgatgacccagagccaggacagcatggctaccagcgtgggcgagcgcgtgaccgtgaattgcaaggccagccagaacgtggacaccaacgtggcctggtatcagcagaagcccggccagtctcctgagcccctgctgttcagcgccagctacagatacaccggcgtgcccgacagattcagcggcagcggctctggcaccgacttcaccctgacaatcagcagcgtgcaggccgaggacgtggccgagtatttctgccagcagtacaacagctaccccctgaccttcggccagggcaccaagctggaaatcaagagaggcggaggcggaagtggaggcggaggatctggcggcggaggctctgaagtgcaggtggaagtgtctggcggcggactggtgcagcctggcggatctatgagactgagctgtgccgtgtccggcttcaccttcagcaactactggatgaactgggtgcgccagtcccccgagaagggcctggaatggatcgccgagatccggctgaagtccaacaacttcgcccggtactacgccgagagcgtgaagggcagattcaccatcagccgggacaacagcaagaacagcctgtacctccagatgatctccctgagagccgaggacaccgccatctactactgcaccagctacggcaactacgtgggccactacttcgaccactggggccagggaacactgctgaccgtgtctagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2068 - DNA, 3426 bp, Artificial Sequence
  Synthetic Polynucleotide encoding a CAR with optional accessory module(s)
atggccttaccagtgaccgccttgctcctgccgctggccttgctgctccacgccgccaggccgagctacgagctgacacagcctccatccgtgtctggcacacctggacagagagtggctatctcctgtagcggcagcagcagcaacatcggcaccagaatggtcacctggtatcagcacgtgccaggcacagcccctaagctgctgatcttcaacaacaaccagcggcctagcggcgtgcccgatagattttctgccagcaagagcggcacaagcgccagcctggctatcatcggactccagtctgacgacgaggccgactactactgtgccacctgggacgacaacgtgaagtcctacgtgttcggcaccggcaccaaagtgacagtgcttggaagtagaggcggaggcggaagtggaggcggaggatctggcggcggaggctctcttgaaatggcccaggttcagctccagcagtggggagctggactgctgaagcctagcgagacactgagcctgacctgtgctgtgtacggcggcagcttcagcggctactactggtcctggatcagacagcctcctggcaaaggactggaatggatcggcgagatcaaccacagcggctccaccaactacaaccccagcctgaagtccagagtgaccatcagcgtggacaccagcaagaaccagttctccctgaagctgagcagcgtgacagccgctgataccgccgtgtactattgcgctagagcccctcagtcttggtacgtgggagatgtgtggggccagggcacactggttacagtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2069 - DNA, 3417 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctcctagcctgtctgtggcccctggaaagacagccagcatcacatgcggcggcaacaacatcggcatgaagtccgtgcactggtatcagcagaggccaggacaggctcctgtgctggtcatctactacgacagcgacagaccctctggcatccccggcagattttccggcagcaactctggcaataccgccacactgaccatctccagagtggaagctggcgacgaggccgactactactgccaagtgtgggataccaccggcgatcaccctggctatgtgtttggcaccggcaccaaagtgacagtgcttggcggaggcggaagtggaggcggaggatctggcggcggaggctctcaagttcaactggttcagagcggagccgaagtgaagaaacctggcagcagcgtgaaggtgtcctgcaaagcaagcggcggcacctttagcagctacgccatctcttgggtccgacaggcacctggacaaggactggaatggatgggcggcatcatccccatcttcggcacagccaattacgcccagaaattccagggcagagtgaccatcaccgccgacgagtctacaagcaccgcctacatggaactgagcagcctgagaagcgaggacaccgccgtgtactattgtgccagaggcgtgtacggctacagcggctctgccccttatgatgagtggggccagggaaccctggtcaccgtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2070 - DNA, 3435 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacccagagccctctgagcctgcctgtgacacctggcgagcctgccagcatctcctgtagaagcagccagagcctgctgcacagcaacggctacaactacctggactggtatctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagaccccccggacctttggacagggcaccaaggtggaaatcaagcggggcggaggcggaagtggaggcggaggatctggcggcggaggctctcaggtgcaactggtgcagtctggcggcggagtggtgcagcctggaagaagcctgagactgagctgtgccgccagcggcttcaccttcagcagctacggaatgcactgggtgcgccaggcccctggcaaaggactggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgcgccagagacttcgactacggcgacagctactactactatggcatggacgtgtggggccagggcacaaccgtgaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2071 - DNA, 3417 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgggcagctacctggcctggtatcagcagaagcctggcgctccccggctgctgatctacgatgcctctcacagagccaccggcatccccgccagattttctggcagcggctccggcaccgacttcaccctgacaatcagctccctggaacccgaggacttcgccgtgtactactgccagcagcggagcaactggccccccatgtataccttcggccagggcaccaagctggaaatcaagagaggcggaggcggaagtggaggcggaggatctggcggcggaggctctgaagtgcagctggtgcagtctggcgctgaggtgtccgtgaaggtgtcctgcaaagccagcggcggcaagaagcccggcagcacctttagcagctacaccatcagctgggtgcgccaggcacctggacagggcctggaatggatgggcggcatcatccccatcttcggcaccgccaactacgcccagaaattccagggcagagtgaccatcaccgccgacaagagcaccagcaccgcctacatggaactgagcagcctgcggagcgaggacacagccgtgtattattgtgccggcgacaccgacagcagcggctactatggcgctgtggactattggggccagggaaccctcgtgaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2072 - DNA, 3366 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtcaggccagccaggacatcaacaactacctgaactggtatcagcagaagcccggcaaggcccccaagctgctgatctacgacgccagcaatctgcagaccggcgtgcccagcagattttccggctctggcagcggcaccgacttcaccttcaccatcgaggacattgccacctactactgccagcagtacaccttcggccctggcaccaaggtggacatcaaaggcggaggcggaagtggaggcggaggatctggcggcggaggctctgaagtgcaactgctggaatctggcggcggactggtgcagcctggcggatctctgagactgagctgtgccgccagcggcttcacctttagctggtacagcatgacctgggtgcgccaggcccctggcaaaggactggaatgggtgtccagcatcgtgccctggggcgatttcacccagtacgccgatagcgtgaagggccggttcaccatcagccgggacaacagcaagaacaccctgtacctgcagatgaacagcctgcgggccgaggacaccgccgtgtactattgtgccaagggacctggctggggcagcttcgatctgtggggcagaggaacccttgtgaccgtgtccagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2073 - DNA, 3033 bp, Artificial Sequence
  Synthetic Polynucleotide encoding a CAR with optional accessory module(s)
atggactggatttggcgcatccttttccttgtcggcgctgctaccggcgcccattccgaggttcagttggtcgaatcaggcgggggcctcgtccaacccggcggaagcctgcggctgtcttgcgcagcaagtggtagtgtgttcaagatcaacgttatggcctggtatcgccaggctccgggaaaagggagagagctggttgcggggatcattagcggtggctccaccagctacgctgacagtgtgaagggaaggttcactatatcacgcgacaacgcaaagaatacattgtacctccagatgaatagcttgcggcccgaagacacggcagtctactattgtgcctttatcacaacagagagcgactatgacctgggccgccggtattgggggcagggaacccttgtgaccgtttcatccacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2074 - DNA, 3396 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtaccgccagcctgagcgtgtccagcacctacctgcactggtatcagcagaagcccggcagcagccccaagctgtggatctacagcaccagcaacctggcctccggcgtgcccagcagattttctggcagcggctctggcaccagctacaccctgaccatcagctccctccagcccgaggacttcgccacctactactgccaccagtaccacagaagccccctgacctttggcggaggcaccaaggtggaaatcaagagaggcggaggcggaagtggaggcggaggatctggcggcggaggctctgaagtgcaactggtggaatctggcggcggactggtgcagcctggcggatctctgagactgagctgtgccgccagcggcttcagcctgaccaaatacggcgtgcactgggtgcgccaggcccctggaaaaggactggaatgggtgggagtgaagtgggctggcggctccaccgactacaacagcgccctgatgagccggttcaccatcagcaaggacaacgccaagaacagcctgtacctccagatgaactccctgcgggccgaggacaccgccgtgtactactgtgccagagatcaccgggacgctatggactactggggccagggaacactcgtgaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2075 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgggaacagccgtggcctggtatcagcagaagcctggcaaggcccccaagctgctgatctacagcgccagctacagatccaccggcgtgcccagcagattttccggctctggcagcggcaccgacttcaccctgaccatctctagcctccagcccgaggacttcgccacctactactgccagcaccactactccgccccctggacatttggcggaggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagaaacggcatgagctgggtgcgccaggcccctggaaaaggactggaatgggtggcaaccgtgtccagcggcggcagctacatctactacgccgacagcgtgaagggccggttcaccatctccagagacaacgccaagaacagcctgtacctccagatgaactccctgcgggccgaggacaccgccgtgtactattgtgccagacagggcaccaccgccctggctaccagattcttcgatgtgtggggccagggcaccctcgtgaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2076 - DNA, 3426 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccagcagcctgaccatgagcgtgggccagaaagtgaccatgtcctgcaagagcagccacagcctgctgaacagccggaaccagaagaactacctggcctggttccagcagaagcccggccagtcccccaagctgctggtgtacttcgcaagcacccgcgagagcggcgtgcccgacagattcatcggcagcggctccggcaccgacttcaccctgaccatcagcaacgtgcaggccgaggacctggccgactacttctgccagcagcactacaccaccctgcccaccttcggcggaggcaccaagctggaaatcaagggcggaggcggaagtggaggcggaggatctggcggcggaggctctcagatccagctggtgcagagcggccctgacctgaagaaacccggcgagacagtgaagatcagttgcaaggcctccggctacaccttcaccaacacaggcatgaactgggtcaagcaggcccctggcaagggcctgaagtggatgggctggatcaacacctacaccggcgagcccacctacgccgacgacttcaagggccggttcaccttcagcctggaaaccagcgccagcaccgcctacctgcagatcaacaacctgaagaacgaggacaccgccacctatttctgcaccagatggggctacggcagcagcctgtactacgccatggactactggggccagggcaccagcgtgaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2077 - DNA, 3396 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagcccccctagcctgtctgcctctgtgggcggcaaagtgaccatcacatgcaaggccagccaggacatcgaccgctacatggcctggtatcaggacaagcccggcaagggacccaagctgctgatccacgataccagcaccctccagcccggcatccccagcagattttctggcagcggctccggcagagactacagcttcagcatcagcaacctggaacccgaggacattgccacctactactgcctccagtacgacaacctgtggaccttcggcggaggcaccaagctggaaatcaagagaggcggaggcggaagtggaggcggaggatctggcggcggaggctctcaggtgcaactggtgcagagcggagccgagcttgtgaagcctggcgcttccgtgaagatgagctgcaaagccagcggctacatcttcaccaactacaacatccactgggtcaagaagtccccaggccagggcctggaatggatcggagccatctaccccggaaacggcgacgccccttacagccagaagttccaggacagagccaccctgaccgccgacaccagcagcagcaccacctacatggaactgagcagcctgaccagcgaggacagcgccgtgtactattgcgtgcgggccaactgggatgtggccttcgcctattggggccagggcacactggtgtccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2078 - DNA, 3399 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccctgccagcctgtctgcctctgtgggcgagacagtgaccatcacctgtcgggtgtccggcaacatccacaactacctggcctggtatcagcagaagcagggcaagagcccccaactgctggtgtacaacgccaagaccctggccgatggcgtgcccagcagattttctggctctggcagcggcacccagtacagcctgaagatcaacagcctccagcccgaggacttcggcagctactactgccagcacttctggtccaacccctacaccttcggcggaggcaccaagctggaaatcaagggcggaggcggaagtggaggcggaggatctggcggcggaggctctcaggtgcaactccagcagtctggcgcttccgtgaaggtgtcctgcaaggccagcgaactcgtgcggcctggcacaggctacgccttcaccaattacctgatcgagtgggtcaagcagaggcccggacagggcctggaatggatcggagtgattaacccaggcagcggcggcaccaactacaacgagaagttcaagggcaaggccaccctgaccgccgacaagagcagcagcacagcctacatgcaactgagcagcctgaccagcgacgacagcgccgtgtacttctgcgcccggtacagaagctacgactggtacttcgacgtgtggggagccggcaccaccgtgacagtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2079 - DNA, 3414 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcagcctgtctgccagcgtgggcgacagagtgaccatcacctgtcggagcagccagcggatcgtgcacagcaacggcaacacctacctggaatggtatcagcagacccccggcaaggcccccaagctgctgatctacaaggtgtccaacagattcagcggcgtgcccagcaggtttagcggctctggcagcggcaccgactacacccctaccatctctagcctccagcccgaggacattgccacctactactgttttcaaggcagccacgtgccccccaccttcggccagggaacaaagctccagatcaccggcggaggcggaagtggaggcggaggatctggcggcggaggctctgaggtgcaactggtggaatctggcggcggagtggtgcagcctggcagaagcctgagactgagctgtagcagcagcggccctaccttcagcgactactacatgtactgggtgcgccaggcccctggcaagggactggaatgggtggcctacatgagcaacgtgggagccatcaccgattaccccgacaccgtgaagggcagacccaccatcagccgggacaacagcaagaataccctgttcctgatggacagcctgcggcccgaggataccggcgtgtacttttgcgccagaggcaccagggacggcagttggttcgcctattggggccagggcacacccgtgaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2080 - DNA, 3396 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagcttcagcagcctgagcgccagcgtgggcgacagagtgaccatcacctgtagagccagccaggacatcagcaactacctgaactggtatcagcagaagcccggcaaggcccccaagctgctgatctactacaccagcagactgcacagcggcgtgcccagcagattttctggcagcggctccggcaccgactacaccctgacaatcagctccctgcagcccgaggacttcgctacctacttctgtcagcaaggcaacaccctgccctggacctttggcggaggcaccaagctggaaatcaagagaggcggaggcggaagtggaggcggaggatctggcggcggaggctctgaagtgcaactggtgcagtccggcggagggctggtgcagagcggaggatctctgagactgagctgcagagccagcggctacaccttcacccggtactggatgctgtgggtgcgccagaggccaggcaagggactggaatgggtggccgagatcaacccccggaacgaccggaccaactacaacgagaagttcaagacccggttcaccatcagcgtggacagaagcaagaacaccctgtacctgcagatggacagcctgcgggccgaggataccgccgtgtacttttgtgctctgggaggcggctacgctatggactactggggccagggaacccttgtgaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2081 - DNA, 3357 bp, Artificial Sequence
  Synthetic Polynucleotide encoding a CAR with optional accessory module(s)
atggaaatgctccagggcctgctgctgctcctgctgctttctatgggcggagcttgggccagcagagagcctcttagaccttggtgtcaccccatcaacgccatcctggccgtggaaaaagagggctgccctgtctgcatcaccgtgaacaccacaatctgcgccggctactgccccaccatgatgagagtgctgcaagccgttctgcctcctctgcctcaggtcgtgtgcacctatcgggacgtccgcttcgagagcatcagactgcctggatgtcctagaggcgtggaccccgtggtgtcttttcctgtggctctgtcctgtagatgcggcccctgtagaagaagcaccagcgattgcggcggacccaaggatcaccctctgacatgcgatcacccacagctgagcggcctgttgtttcttggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2082 - DNA, 3399 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagtctccggcgtcactgtccgcctccgtgggggagactgtgactattatttgtagggcatcagttaacatctactcttatttggcctggtaccagcagaagcaaggcaagagtcctcagctgctggtgtataatgcgaagatcctggcagagggcgtgccgagccggttctccggcagcggctcaggtacccaattttccctcaagatcaattcactgcagccagaggactttggcagttactattgtcaacaccactacggcacattcactttcgggtccggtacaaaattggagattaagcgaggcggaggcggaagtggaggcggaggatctggcggcggaggctctcaggtacagttgaaagaaagcgggcctggactggtagcgccttcccaatctctctccatcacgtgcaccatctctggcttctccctgacttcctatggagttcactgggtgaggcagccccccggcaagggactggaatggctggtcgtcatctggtccgacgggtccacaacctacaactccgctctgaaaagtcggctctctatttctaaagataatagcaagagccaggtgtttctgaaaatgaactctctgcagaccgatgatacggccatttactactgcgcttcacactatggctcaaccttggcattcgcttcctggggccacggaacactggtgaccgtttccgcagccacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2083 - DNA, 3423 bp, Artificial Sequence
  Synthetic Polynucleotide encoding a CAR with optional accessory module(s)
atggccttaccagtgaccgccttgctcctgccgctggccttgctgctccacgccgccaggccggacattgtgatgacccagtctcacaaattcatgtccacatcagtaggagacagggtcagcgtcacctgcaaggccagtcagaatgtgggtaataatgtagcctggtatcaacagaaaccagggcaatctcctaaagtactgatttactcggcatcctaccggtacagtggagtccctgatcgcttcacaggcagtggatctgggacagatttcactctcaccatcagtaatgtgcagtctgaagacttggcagagtatttctgtcagcaatataacacctatccattcacgttcggctcggggacaaagttggaaataaaaggcggaggcggaagtggaggcggaggatctggcggcggaggctctgaggtacagctggaggaaagcggtggaggactggtgcaacctggagggtctatgaagctctcttgcgtagcttctgggttcacgttctccaattactggatgaactgggtgcggcagtcccccgagaaaggcctggaatgggtagcagaaattcggttcaagtcccataactatgctacacactttgccgagtctgtcaaaggccggttcactattagtcgagacgacagcaagtcttcagtctacctgcagatgaataacttgcgggcagaggacacaggtatctactactgcaccaggagaatcggcaactccgactatgactggtggtactttgacgtctggggagcaggcaccagcgtgacggtgagttcagcctcaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2084 - DNA, 3411 bp, Artificial Sequence; identical to SEQ ID NO: 1969
  Synthetic Polynucleotide encoding a CAR with optional accessory module(s)

SEQ ID NO: 2085 - DNA, 3429 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtgctgacacagcctccatccgtgtctggcgctccaggccagagagtgaccatctcctgtaccggcagcagcagcaacatcggagccggctatgacgtgcactggtatcagcaactgcccggcaccgcccccaagctgctgatctacggcaacagcaacagacccagcggcgtgcccgatagattcagcggcagcaagagcggcacaagcgccagcctggctatcactggactccaggccgaggacgaggccgactactactgccagagctacgacaacagcctgtcctcctgggtgttcggcggaggcaccaagctgacagtgctgggccagcctaagggcggaggcggaagtggaggcggaggatctggcggcggaggctctgaagtgcaactccagcagagcggagccgaagtgaagaaacccggcagctccgtgaaggtgtcctgcaaggcttccggcggcaccttcagcagctacgccatttcttgggtgcgccaggcccctggacagggcctggaatggatgggcagaatcatccccatcctgggaatcgccaactacgcccagaaattccagggccgcgtgaccatcaccgccgacaagagcacaagcaccgcctacatggaactgagcagcctgcggagcgaggacaccgccgtgtactactgcgccagagatgtgggcagcggctcctacagcctggactattggggccagggcaccctcgtgaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2086 - DNA, 3420 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtcgtgacacagcctccatctgtgtctgccgcccctggccggaaagtgaccatctcttgtagcggcagcagcagcaacatcggcagcaactacgtgtcctggtatcagcaggtgcccggcaccgcccctaagctgctgatctacgaggacgacaagcggcccagcggcatccccgatagattcagcggctctaagagcggcaccagcgccacactgggcatcaccggactccagacaggcgacgaggccgactacttctgcgccacctgggacagaaccgtgaacgtggtgcgctttggcggcggaaccagactgacagtgcacagccagcctaagggcggaggcggaagtggaggcggaggatctggcggcggaggctctcaactccaactccaggaaagcggccctggcctcgtgaagcctagcgagacactgagcctgacctgcaccgtgtctggcggcagcatctccagcagctcctactactggggctggatcagacagccccctggcaagggcctggaatggatcggctccatctactacagcggaagcacctactacaaccccagcctgaagtcccgcgtgaccatcagcgtggacaccagcaagaaccagttctccctgaagctgagcagcgtgacagccgccgataccgccgtgtactactgtgccagacatgtgggccacgagctggattactggggccagggcacactcgtgaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2087 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgccagctctctgcagtctggcgtgccatctggctttagcggcagcggctctggcaccgacttcaccctgaccatcagctccctgcagcccgaggacttcgccacctactactgccagcagagctacagcacccccctgacctttggcggaggcaccaaggtggaaatcaagagaggcggcggaggctcaggcggaggcggatctggcgggggaggatctcaggtgcaactgcaggaatctggccctggcctcgtgaagcccagcgagacactgagcctgacctgtaccgtgtctggcggctctgtgtccagcggcagctactactggtcctggatcagacagccccctggcaagggcctggaatggatcggctacatctactacagcggctccaccaactacaaccccagcctgaagtcccgcgtgaccatctccgtggacaccagcaagaaccagttctccctgaagctgagcagcgtgacagccgccgataccgccgtgtactactgtgccagagagggcaagaacggggccttcgacatctggggccagggcacaatggtcaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2088 - DNA, 3060 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgatgttcagttggtggagtctggtggcggtttggtgcagccaggtggctccctgcgactcagttgtgcagcctccgggttcattctggattactacgctattggttggtttcgacaggcccccggaaaggagagagagggcgtgctctgcattgatgccagcgacgacattacctactacgccgattctgtgaagggccgcttcaccatcagtagagacaatagcaagaatacagtctacctgcagatgaactccctgcgcccagaagacactgccgtctactactgtgctacccctatcgggctttcttcctcttgccttctcgaatatgactacgattactgggggcaggggacgctggtcaccgtgtctagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2089 - DNA, 3549 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgatgttcagttggtggagtctggtggcggtttggtgcagccaggtggctccctgcgactcagttgtgcagcctccgggttcattctggattactacgctattggttggtttcgacaggcccccggaaaggagagagagggcgtgctctgcattgatgccagcgacgacattacctactacgccgattctgtgaagggccgcttcaccatcagtagagacaatagcaagaatacagtctacctgcagatgaactccctgcgcccagaagacactgccgtctactactgtgctacccctatcgggctttcttcctcttgccttctcgaatatgactacgattactgggggcaggggacgctggtcaccgtgtctagcctcgagggaggtagcggctccgggggaggcggaagtggaggcggaggatctgggtctggaggaagcggatctggaggctcagggtcagggggctcaggcagtggaggctctttcgaagtgcaactggtggagtccggcggtggactggtacagcctgggggttcactgcgcctgtcctgcgccgccagcggaagaacctattacctcaatgctatgggttggttccgccaggccccaggaaaggagcgcgagttcgtggcggctattgactggtccgaggggaacaaggactatgctgattccgtgaagggcaggtttaccatcagccgggataattcaaaaaatactgtttatttgcagatgaactctcttagaccagaagacactgctgtctattactgcgccgctgacacccctccttggggaccactgatttatatcgaaagctatgattcctgggggcagggcacactcgtcaccgtgagtagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2090 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggaccagatcgtgctgacccagtcccccgctattatgtccgcatcaccgggcgaaaaagtgacgatctcctgtagcgcttcatctagcgtctcctacatgtattggtatcaacagaaacctgggtctagcccaaagccgtggatctacagaaccagtaaccttgccagtggggtgccagcccgcttcagcggtagtggcagtggaacttcctatagcctcacaataagcaacatggaggctgaagatgccgctgcctattactgccagcagtaccacagttacccaaccacgttcggcgggggaactaagctcgaagtaaaaggcggaggcggaagtggaggcggaggatctggcggcggaggctctgaggtgcagctggtggaatctgggggcggcctggtccaacctaagggatcactcaagctctcttgtgcggccagcggattctctttcaatacctatgctatgaattgggtgagacaggcgcccggaaagggcctcgaatggatagcccatatccggtcaaaatcaaacaatttcgcaacctactatgcggactccgtgaaggaccgattttccatctcccgagatgcctccgagaatattctgttcctgcagatgaataacctcaagacagaggacaccgccatgtactactgtgtgcgccagggcggtgactttcccatggattactgggggcaggggaccagcgtgaccgtgagctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2091 - DNA, 3399 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagcagcagcagcttcagcgtgagcctgggcgacagagtgaccatcacctgcatggccagcgaggacatctacatcagactggcctggtaccagcagaagcccggcaacgcccccagactgctgatcagcgccgccaccagcctggagaccggcgtgcccagcagattcagcggcagcggcagcggcaaggactacaccctgagcatcaccagcctgcagaccgaggacgtgggcacctactactgccagcagtactggagcagcccctggaccttcggcggcggcaccaagctggagatcaacggcggaggcggaagtggaggcggaggatctggcggcggaggctctgacgtgcagctgcaggagagcggccccggcctggtgaagcccagccagagcctgagcctgacctgcaccgtgaccggctacagcatcaccagcgactacacctggaactggatcagacagttccccggcaacaagctggagtggatgggctacatcacctacagcggcagcaccagctacaaccccagcctgaagagcagaaacagcatcaccagagacaccagcaagaaccagttcttcctgcagctgaacagcgtgaccaccgaggacaccgccacctactactgcgccagactgggcagaagatacacaatggactactggggccagggcaccagcgtgaccgtgagcagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2092 - DNA, 3396 bp, Artificial Sequence
  Synthetic Polynucleotide encoding a CAR with optional accessory module(s)
atggccctgcctgtgacagctctgctgctgcctctggcactgctgctgcacgccgccagacctgatgtgcagctccaggaaagcggccctggcctcgtgaagcctagccagagcctgagcctgacatgcaccgtgaccggctacagcatcaccagcgactacacctggaactggatcagacagttccccggcaacaagctggaatggatgggctacatcacctacagcggcagcaccagctacaaccccagcctgaagtcccggaactccatcaccagagacaccagcaagaaccagttcttcttgcagctgaacagcgtgaccaccgaggacaccgccacctactactgcgccagactgggcagacggtacaccatggactattggggccagggcacctccgtgaccgtgtctagcggaggcggaggaagtggcggcggaggatctgggggaggcggaagcgatatccagatgacccagtccagcagcagcttcagcgtgtccctgggcgacagagtgaccatcacctgtatggcctccgaggacatctacatccggctggcctggtatcagcagaagcccggcaacgcccccagactgctgattagcgccgccacctctctggaaaccggcgtgccaagcagattcagcggctctggcagcggcaaggactacaccctgagcatcacctccttgcagaccgaggacgtgggcacctactattgccagcagtattggagcagcccctggacctttggcggaggcacaaagctggaaatcaacacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2093 - DNA, 3399 bp, Artificial Sequence
  Synthetic Polynucleotide encoding a CAR with optional accessory module(s)
atggccctgcctgtgacagctctgctgctgcctctggcactgctgctgcacgccgccagacctgacatccagatgacccagagcagcagcagcttcagcgtgtccctgggcgacagagtgaccatcacatgcaaggccagcgaggacatctacatccggctggcctggtatcagcagaagcccggcaacgcccccagactgctgattagcgccgccacctctctggaaaccggcatccccagcagattctccggctctggcagcggcgaggactacaccctgacaatcaccagcctccagaccgaggacgtggcaacctactactgccagcagtattggaccaccccctggacctttggcggaggcaccaagctggaaatcaagagaggcggaggcggaagtggaggcggaggatctggcggcggaggctctgatgtgcagctccaggaatctggccccggactcgtgaagcctagccagagcctgagcctgacatgcaccgtgaccggctacagcatcaccatcgactacacctggaactggatcagacagttccccggcaacaaactggaatggatgggctacatcacctacagcggcagcaccgactacaaccccagcctgaagtccagaagctccatcaccagagacacctctatgaaccagttcttcttgcagctgaacagcgtgaccaccgaggacaccgccacctactattgcgccagactgggcagaagatacgccctggactattggggccagggcaccagcgtgacagtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2094 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggacatcgtaatgacccaggctgccccatccataccagtcactcccggtgaatccgtgtctatatcttgtaggtccgataagagtctgcttcacagcaacggcaatacttatcttttctggtttttgcagcgaccgggacaaagcccacaactgctgatctatagaatgtcaaatcttgcatcaggggtcccagatcgctttagtggatctgggtcaggcacagctttcaccctgagaatctccggagtggaagcagaagacgtaggcgtgtattactgtatgcagcaccttgagtatccttatacctttggaggcggaactaagctcgaaattaaaggcggaggcggaagtggaggcggaggatctggcggcggaggctctcaggttcaactgcagcagtctggacctgaactggtgaagcctggggcctcagtgaagatgtcctgcaaggcttctggctacgcattcagtagttcctggttgaactgggtgaggcagaggcctggaaagggtcttgagtggattggacggatttatcctggagatggagaaaatcactataatgggaaattcaagggcaaggccacactgactgcagacaaatcctccagcacaggctacatgcaactcagcagcctgacgtctgaggactctgcggtctacttctgtgcaagttattatgaagggggttattggggccaagggactctaatcactgtctctgcaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2095 - DNA, 3399 bp, Artificial Sequence
  Synthetic Polynucleotide encoding a CAR with optional accessory module(s)
atggccttaccagtgaccgccttgctcctgccgctggccttgctgctccacgccgccaggccggacatcgtactgacacagagccccgcttctctggcagtgtcactgggccagtccgttacaatatcctgtcgggcgagtgaatccgtggaatactatggaacaagtctcatgcagtggtatcagcagaaacctggacagccccccaagctgctcatctacggtgcgtcaaatgtcgagagtggggttccggcccgattcagtggttccgggagtggcacagactttagcctcaacatccatcctgttgaggaagacgatattgccatgtatttttgccaacagtcccgcaaagtcccctggacctttggtggaggaactaagctggagatcaagggcggaggcggaagtggaggcggaggatctggcggcggaggctctgaggtcaagctggtagagagtggaggtgggctggttaaaccaggggggagcagaaaactgagttgtgccgcaagtggcttcaccttttctagctataccatgagctgggtaagacaaactccagcaaagcgccttgagtgggtcgcaacaattagcagcggatcttctactatttattacgctgacactgttaagggccggtttaccatatcaagagacaacgccaagaatacccttttccttcaaatgacttcactgcggtccgaggatacggcaatgtactattgtgcacgacggtggtttctcgactgctggggccaggggactacccttaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2096 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccggaccaggtgcagctgcagcagtcgggcccaggactggtgaagccttcggagaccctgtccctcacctgcactgtctctggtgactccatcagtagttactactggagctggatcaggcagcccccagggaagggactggagtggattgggtatatctattacagtgggagcaccaactacaacccctccctcaagagtcgagtcaccatatcagtagacacgtccaagagccagttctccctgaagctgagctctgtgaccgccgcagacacggccgtgtattactgtgcgcgcggcaggtacttcgatgtctggggacgaggcactatggtgactagcagcggcggaggcggaagtggaggcggaggatctggcggcggaggctcttcctcctacgtgctgactcagcctccctccgtgtctgggtctcctggacagtcgatcaccatctcctgcactggaaccagcagtgacgttggtggttataactatgtctcctggtaccaacaacacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgcagctcatatacaaccaggagcacccgagttttcggcggagggaccaagctgaccgtcctaggtgccgccgcaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2097 - DNA, 3411 bp, Artificial Sequence
  Synthetic Polynucleotide encoding a CAR with optional accessory module(s)
atggccttaccagtgaccgccttgctcctgccgctggccttgctgctccacgccgccaggccggacatcgtaatgacacagtctcccctgtccctccctgtcacaccaggtgaacctgccagtatttcttgtagatccagtaagtcacttctgcactccaatgggaacacctacctgtattggttccagcaaaagcctggtcaggcacctcgcttgcttatttataggatgtccaatcttgcatccggcgtgccagaccgattctcaggctccggctctggtactgcatttaccctgaaaatctcccgcgtggaagcagaagatgtgggcgtgtactactgtatgcagcacatcgagtaccccttcacgtttggtcaaggcacaaagctggaaatcaaaggcggaggcggaagtggaggcggaggatctggcggcggaggctctcaggtccagctcgtccagtctggacccgaagtcaagaagccaggcgcctctgtgaaggtttcttgtaaggccagcggatatacattcactaattcatggatgaactgggtgaggcagcgccctggcaaggggcttgagtggatcgggcggatttacccaggggatggcgagacaatttacaacgggaaatttcgggtgagagtgacgatcaccgcagacgaatctacaagcacggcctacatggagttgtcctctctcaggagtgaggacaccgccgtctactattgtgctagaggttatgacgactattcattcgcatactggggccagggcaccaccgtcacagtatcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2098 - DNA, 3411 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgatgacccagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccaccagtacggcagcagcccccagacctttggacagggcaccaaggtggaaatcaagcggggcggaggcggaagtggaggcggaggatctggcggcggaggctctgaagtgcagctggtgcagtctggggccgaagtgaagaaacccggcagctccgtgaaggtgtcctgcaaggcttccggcggcaccttcagcagctacgccatttcttgggtgcgccaggcccctggacagggactggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccgtgcactacggcgactacgtgttcagcagcatggacgtgtggggccagggcacaaccgtgaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2099 - DNA, 3420 bp, Artificial Sequence
  Synthetic Polynucleotide encoding a CAR with optional accessory module(s)
atggccttaccagtgaccgccttgctcctgccgctggccttgctgctccacgccgccaggccggacgagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagccccagaacattcggccagggcaccaaggtggaaatcaagagaggcggaggcggaagtggaggcggaggatctggcggcggaggctctgaagtgcaactggtgcagagcggagccgaagtgaagaaacccggcagctccgtgaaggtgtcctgcaaggcttccggcggcaccttcagcagctacgccatttcttgggtgcgccaggcccctggacagggcctggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccagaggccccgagtattgcatcaacggcgtgtgcagcctggacgtgtggggccagggaacaaccgtgaccgtgtctagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2100 - DNA, 3426 bp, Artificial Sequence
  Synthetic Polynucleotide encoding a CAR with optional accessory module(s)
atggccttaccagtgaccgccttgctcctgccgctggccttgctgctccacgccgccaggccggacatcgagctgacccagagccctagcagcctggctgtgtctgccggcgagaaagtgaccatgagctgcaagagcagccagagcctgctgaacagccggacccggaagaatcaactggcctggtatcagcagaagcccggccagtctcccgagctgctgatctactgggccagcaccagacagagcggcgtgcccgatagattcacaggcagcggctccggcaccgacttcaccctgacaatcagcagcgtgcaggccgaggacctggccgtgtactactgccagcagagctacaacctgctgaccttcggccctggcaccaagctggaagtgaagagaggcggaggcggaagtggaggcggaggatctggcggcggaggctctgtgaagctgcaggaatctggcggcggattcgtgaagcctggcggctctctgaaggtgtcctgtgccgccagcggcttcaccttcagcagctacgccatgtcctgggtgcgcctgagccccgagatgagactggaatgggtggcaaccatcagctccgcaggcggctacatcttctacagcgactccgtgcagggccggttcaccatctccagagacaacgccaagaacaccctgcatctgcagatgggcagcctgagaagcggcgacaccgccatgtactattgcgccagacagggcttcggcaactacggcgactactacgctatggactactggggccagggaaccaccgtgaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2101 - DNA, 3423 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtcggagcagccagaacatcgtgcacagcaacggcaacacctacctggactggtatcagcagacccccggcaaggcccccaagctgctgatctacaaggtgtccaacagattcagcggcgtgcccagcaggtttagcggctctggcagcggcaccgacttcaccttcaccatcagctccctccagcccgaggacattgccacctactactgcttccagtacagccacgtgccctggaccttcggccagggcacaaagctccagatcggcggaggcggaagtggaggcggaggatctggcggcggaggctctcaggtgcagctccagcagtctggggccgaagtgaagaaacccggcagcagcgtgaaggtgtcctgcaaggccagcggctacacctttaccaactactacatctactgggtgcgccaggccccaggccagggactggaatggatcggcggcatcaatcctaccagcggcggcagcaacttcaacgagaagttcaagacccgcgtgacaatcaccgccgacgagagcagcaccaccgcctacatggaactgagcagcctgcggagcgaggataccgccttctacttctgcacccggcagggcctgtggttcgactctgatggcagaggcttcgacttctggggccagggaaccaccgtgaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2102 - DNA, 3111 bp, Artificial Sequence
  Synthetic Polynucleotide encoding a CAR with optional accessory module(s)
atggccttaccagtgaccgccttgctcctgccgctggccttgctgctccacgccgccaggccgctgttcaaccaggaagtgcagatccccctgaccgagagctactgcggcccctgccccaagaactggatctgctacaagaacaactgctaccagttcttcgacgagagcaagaattggtacgagagccaggcttcctgcatgagccagaacgccagcctgctgaaggtgtacagcaaagaggaccaggatctgctgaagctggtcaagagctaccactggatgggcctggtgcacatccccaccaacggctcttggcagtgggaggacggcagcatcctgagccccaacctgctgaccatcatcgagatgcagaagggcgactgcgccctgtacgccagcagcttcaagggctacatcgagaactgctccacccccaacacctacatctgtatgcagcggaccgtgggcggaggcggaagtggaggcggaggagacacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2103 - DNA, 3393 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctggacctttggacagggcaccaaggtggaaatcaagagaggcggaggcggaagtggaggcggaggatctggcggcggaggctctcaagtgcatctccaggaaagcggacccggcctcgtgaagcctagcgagacactgagcctgacctgcaccgtgtccgacgacagcatcagcagctactactggtcctggatcagacagccccctggcaagggcctggaatggatcggccacatcagctacagcggcagcgccaactacaaccccagcctgaagtccagagtgaccatctccgtggacaccagcaagaaccagttctccctgaagctgagcagcgtgacagccgccgacaccgccgtgtattattgcgccaactgggacgacgccttcaacatctggggccagggcacaatggtcaccgtgtctagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2104 - DNA, 3399 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagacccctctgaccctgagcgtgaccattggacagcccgccagcatctcctgcaagagcagccagagcctgctggacagcgacggcaagacctatctccactggctgttgcaacggccaggtcagagccccaagagactgatcttcctggtgtccaagctggactccggcgtgcccgatagattcacaggcagcggctccggcaccgacttcaccctgaagatcagccgggtggaagccgaggacctgggcgtgtactactgttggcagggcacccacttcccccagacctttggcggcggaacaaagctggaaatcaagggcggaggcggaagtggaggcggaggatctggcggcggaggctctgtgcaactccaagagtccggccctgacctcgtgaagcctagccagtctctgagcctgacctgcaccgtgaccggctacagcatcaccagcggctactcttggcactggatcagacagttccccggcaacaagctggaatggatgggctacatccactacagcggcgacaccgactacaaccccagcctgaagtcccggttctccatcaccagagacaccagcaagaaccagttcttcttgcaactgaactccgtgaccaccgaggacaccgccacctactactgtgccacccctggcggctttgtgtactggggccagggaacactcgtgaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2105 - DNA, 3411 bp, Artificial Sequence
  Synthetic Polynucleotide encoding a CAR with optional accessory module(s)
atggccttaccagtgaccgccttgctcctgccgctggccttgctgctccacgccgccaggccggaccagagcgagctgacccagcctagaagcgtgtccggcagccctggacagagcgtgaccatcagctgtaccggcaccgagagagatgtgggcggctacaactacgtgtcctggtatcagcagcaccccggcaaggcccccaagctgatcatccacgacgtgatcgagcggagcagcggcgtgcccgatagattcagcggcagcaagagcggcaacaccgccagcctgacaatcagcggactgcaggccgaggacgaggccgactactactgctggtctttcgctggcggctactacgtgttcggcaccggcacagatgtgaccgtgctgggcggaggcggaagtggaggcggaggatctggcggcggaggctctttcgaagtgcagctgctggaatctggcggcggactggtgcagcctggcggatctctgagactgagctgtgccgcctccggcttcaccttcagcacctaccagatgagctgggtgcgccaggcccctggcaaaggactggaatgggtgtccgggatcgtgtccagcggcggctctacagcctacgccgatagcgtgaagggccggttcaccatcagccgggacaacagcaagaacaccctgtacctgcagatgaacagcctgagagccgaggacaccgccgtgtactattgtgccggcgagctgctgccctactacggcatggatgtgtggggccagggcaccaccgtgaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2106 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccggaccagagcgagctgacccagcctagaagcgtgtccggcagccctggacagagcgtgaccatcagctgtaccggcaccgagagagatgtgggcggctacaactacgtgtcctggtatcagcagcaccccggcaaggcccccaagctgatcatccacgacgtgatcgagcggagcagcggcgtgcccgatagattcagcggcagcaagagcggcaacaccgccagcctgacaatcagcggactgcaggccgaggacgaggccgactactactgctggtctttcgctggcggctactacgtgttcggcaccggcacagatgtgaccgtgctgggcggaggcggaagtggaggcggaggatctggcggcggaggctctgaagtgcagctgctggaatctggcggcggactggtgcagcctggcggatctctgagactgagctgtgccgccagcggcttcaccttcagcacctacgagatgcactgggtgcgccaggcccctggcaaaggactggaatgggtgtccgtgatcctgagcagcggcggagagacaaactacgccgacagcgtgaagggccggttcaccatcagccgggacaacagcaagaacaccctgtacctccagatgaacagcctgcgggccgaggacaccgccgtgtactattgtgccggaatgctgctgccctactacggcatggatgtgtggggccagggcaccaccgtgaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2107 - DNA, 3114 bp, Artificial Sequence
  Synthetic Polynucleotide encoding a CAR with optional accessory module(s)
atggccttaccagtgaccgccttgctcctgccgctggccttgctgctccacgccgccaggccgggctggtttctggacagccctgacagaccctggaatcctccaacattcagccccgctctgctggtggttaccgagggcgataatgccaccttcacctgtagcttcagcaacaccagcgagagcttcgtgctgaactggtacagaatgagccccagcaaccagaccgacaagctggccgcctttcctgaggatagaagccagcctggacaggactgccggttcagagttacccagctgcctaacggcagagacttccacatgagcgttgtgcgggccagaagaaacgacagcggcacatatctgtgcggagccatctctctggcccctaaggctcagatcaaagagagcctgagagccgagctgagagtgacagaaagacgggccgaagtgcccacagctcacccttcaccttctccaagacctgccggccagttccagacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2108 - DNA, 3399 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccaggatgtgtctacagccgtggcctggtatcagcagaagcctggaaaggcccctaagctgctgatctacagcgccagctttctgtacagcggcgtgcccagcagattttctggcagcggctctggcaccgacttcaccctgacaatatccagcctccagcctgaggacttcgccacctactactgccagcagtacctgtatcaccccgccacctttggacagggcaccaaggtggaaatcaagagaggcggaggcggaagtggaggcggaggatctggcggcggaggctctgaagtgcagctggttgaatcaggtggcggcctggttcaacctggcggatctctgagactgagctgtgccgccagcggcttcacctttagcgacagctggattcactgggtccgacaggcccctggcaaaggacttgaatgggtcgcctggatcagcccttatggcggcagcacctattacgccgacagcgtgaagggcagattcaccatcagcgccgacaccagcaagaacaccgcctacctccagatgaactccctgagagccgaagataccgccgtgtactactgcgccagaaggcattggcctggcggctttgattattggggccagggcacactggtcaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2109 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggccatcgtgatgacccagacaccttctccagtgtctgccgccgttggcggcacagtgacaatcaactgtcaggccagcgagagcgtgtacagcaacaactacctgagctggttccagcagaagcccggccagcctcctaagctgctgatctacctggcctccacactggcaagcggagtgcccagtagattcaaaggcagcggctctggcacccagttcaccctgacaattagcggcgtgcagtgtgacgatgccgccacctattactgcatcggcggcaagagcagcagcaccgatggcaatgcttttggcggcggaacagaggtggtcgttagaggcggaggcggaagtggaggcggaggatctggcggcggaggctctcaatctctggaagaaagcggaggcagactggtcaagcccgacgagacactgaccatcacctgtaccgtgtccggcatcgacctgagcagcaatggactgacctgggtccgacaagctcctggcgaaggactggaatggatcggcaccatcaacaaggacgccagcgcctactatgcctcctgggccaaaggcaggctgaccatctctaagcccagctccacaaaggtggacctgaagatcacaagccccaccaccgaggacaccgccacatacttttgtggccggatcgccttcaagaccggcacctctatttggggacctggcacactggtcaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2110 - DNA, 3396 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggcgctgaagtgaagaaacctggggcctctgtgaaggtgtcctgcaaggcttccggctacacctttaccagctacgacgtgcactgggtccgacaggctccaggacaaagactggaatggatgggatggctgcacgccgataccggcatcaccaagttcagccagaaattccagggccgcgtgacaatcaccagagacacatctgccagcaccgcctacatggaactgagcagcctgagaagcgaggacaccgccgtgtactactgcgccagagagagaatccagctttggttcgactactggggccagggaaccctggtcacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2111 - DNA, 3453 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgatgacccagagccccctgagcctgcctgtgacacctggcgagcctgccagcatctcctgtagaagcagccagagcctgctgcacagcaacggctacaactacctcgtgtggtatctccagaagcccggccagagccctcaactgctgatctacctgggcagcatcagagccagcggcgtgcccgatagattttccggcagcggctccggcaccgacttcaccctgaagatcagccgggtggaagccgaggacgtgggcgtgtactactgtatgcagcccctccagacccccatcaccttcggccagggcaccagactggaaatcaagagaggcggaggcggaagtggaggcggaggatctggcggcggaggctctggactccagtgtgtggccgctcctagatgggtgctgagccaggtgcaactccagcagtggggagccggactgctgaagcctagcgagacactgagcctgacatgcgccgtgtacggcggcagcttcagcggcaattactggtcctggatcagacagccccctggcaagggcctggaatggatcggcgagatcaaccacagcggcagcaccaactacaaccccagcctgaagtccagagtgaccatcagcgtggacaccagcaagaaccagttctccctgaagctgagcagcgtgacagccgccgacaccgccgtgtattactgtgccagaggcggctcctacaattacttcgactactggggccagggaaccctcgtgaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2112 - DNA, 3444 bp, Artificial Sequence
  Synthetic Polynucleotide encoding a CAR with optional accessory module(s)
atggccttaccagtgaccgccttgctcctgccgctggccttgctgctccacgccgccaggccggaccagctgacacagagccctagcagcgtgtcagccagcgtgggcgacagagtgaccatcacctgtagagccagccggggcatcagctcttggctggcctggtatcagcagaagcccggcaaggcccccaagctgctgatctacacagccagcagcctccagagcggcgtgcccagcagattttctggcagcggctccggcaccgacttcaccctgacaatcagcagcctccagcccgaggacttcgccacctactactgccagcaggcttacagcttcccccggacctttggccagggcaccaaggtggaaatcaagcggggcggaggcggaagtggaggcggaggatctggcggcggaggctctgtggctgctcctagatgggtgctgagccaggtgcagctccaggaatctggccccggactcgtgaagcctagccagaccctgagcctgacctgtaccgtgtctggcggcagcatcagcagcggcggctactactggatctggatcagacagcaccctggcaagggcctggaatggatcggctacatctactacaacggcaacacctactataaccccagcctgaagtcccgcgtgaccatgagcgtggacaccagcaagaaccagttctccctgaagctgtccagcgtgacagccgccgataccgccgtgtactactgcgccagagatggcatcaccatgatccggggctactattacggcatggacgtgtggggccagggaaccaccgtgaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2113 - DNA, 3366 bp, Artificial Sequence
  Synthetic Polynucleotide encoding a CAR with optional accessory module(s)
atggccttaccagtgaccgccttgctcctgccgctggccttgctgctccacgccgccaggccggacatcgtcgtgacacagagccctgcttccctggccgtgtccctgggacagagagccaccatcagctaccgggccagcaagagcgtgtccaccagcggctacagctacatgcactggaaccagcagaagcccggccagccccctagactgctgatctacctggtgtccaacctggaaagcggcgtgcccgccagattttctggcagcggctctggcaccgacttcaccctgaacatccaccccgtggaagaagaggacgccgccacctactactgccagcacatcagagagctgaccagaagcgagggcggaccctcttggaagggcggaggcggaagtggaggcggaggatctggcggcggaggctctgaagtgaagctggaagagtctggcggcgaccttgtgaagcctggcggcagcctgaagctgagctgtgccgccagcggctttaccttctccggctacggcatgagctgggtgcgccagacccccgacaagagactggaatgggtggcaaccatcagcagcggcggcagctacacctactatcccgacagcgtgaagggccggttcaccatctccagagacaacgccaagaacaccctgtacctgcagatgtcctccctgaagtccgaggacaccgccatgtactattgcgccaggcacgaaggcggctactacggcagttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2114 - DNA, 3414 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcagcctgtctgccagcgtgggcgacagagtgaccatcacctgtagagccagccagggcatcagcaactacctggcctggtatcagcagaaaaccggcaaggtgcccaagttcctgatctacgaggccagcaccctgcagagcggcgtgccaagtagattttccggcggaggcagcggcaccgacttcaccctgacaatcagctccctgcagcccgaggacgtggcaacctactactgccagaactacaacagcgcccccttcaccttcggccctgggaccaaggtggacatcaagggcggaggcggaagtggaggcggaggatctggcggcggaggctctcaggtgcaactggtggaatctggcggaggcgtggtgcagcctggcagaagcctgagactgagctgtgccgccagcggcttcgccttcagcagatacggaatgcactgggtgcgccaggcccctggcaaaggactggaatgggtggccgtgatttggtacgacggcagcaacaagtactacgccgacagcgtgaagggccggttcaccatcagccgggacaacagcaagaacacccagtacctgcagatgaacagcctgcgggccgaggataccgccgtgtactattgtgccagaggcggcgacttcctgtactactactattacggcatggacgtgtggggccagggaaccaccgtgaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2115 - DNA, 3387 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctaccagcgtgggcgatagagtgaccctgacctgcaaggccagccaggatgtgggaaccgccgtggactggtatcagcagaagcctggccccagccccaagctgctgatctactgggccagcaccagacacaccggcatccccagcagattttccggcagcggctccggcaccgacttcaccctgacaatcagctccctgcagcccgaggacttcgccgactactactgccagcagtacaacagctaccccctgaccttcggccctgggaccaaggtggacatcaagggcggaggcggaagtggaggcggaggatctggcggcggaggctctgaagtgcaactggtgcagagcggccctgaagtgaagaaacccggcgctaccgtgaagattagctgcaagaccagcggctacaccttcaccgagtacaccatccactgggtcaagcaggcccctggcaagggcctggaatggatcggcaacatcaaccccaacaacggcggcaccacctacaaccagaagttcgaggacaaggccaccctgaccgtggacaagagcaccgacaccgcctacatggaactgagcagcctgcggagcgaggataccgccgtgtactattgtgccgccggatggaacttcgactactggggacagggcaccctgctgaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2116 - DNA, 3390 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacatctacccctacctgaactggttccagcagaagcccggcaaggcccccaagaccctgatctaccggaccaacagactgctggacggcgtgcccagcagattttctggcagcggctccggcaccgacttcaccttcaccatcagctccctccagccctactactgcctccagtacgacgagttccccctgacctttggagccggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcaccagcaacatgggcgtgggctggatcagacagcctcccggaaaagccctggaatggctggcccacatttggtgggacgacgacaagtactacagccccagcctgaagtcccggctgacaatcaccaaggacaccagcaagaaccaggtggtgctgaccatgaccaacatggaccccgtggacaccgccacctactattgcgtgcggagcaactacggctacgcttggtttgcctactggggccagggcaccctcgtgaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2117 - DNA, 3390 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccagaaattcatgagcaccagcgtgggcgacagagtgaacgtgacctgcaaggccagccagaacgtgggcaccaacgtcgtgtggtatcagcagaaaaccggccagagccccaaggccctgatccacagcgccagctacagatacagcggcgtgcccgacagattcaccggcagcggctctggcaccgacttcaccctgaccctgagcaacgtgcagagcgaggacctggccgaatacttctgccagcactacaacagcttcccttacaccttcggcggaggcaccaagctggaaatcaagagaggcggaggcggaagtggaggcggaggatctggcggcggaggctctcaggtgcaactccagcagagcggagccgaactcgtgcggcctggcgtgtccgtgaagattagctgcaagggctccggctacaggttcaccgactaccccatccactgggtcaagcagagccacgccaagagcctggaatggatcggcatcatcagcacctactacggcgacgtgaccaacaaccccaagttccggggcaaggccaccatgacagtggacaagagcagcaccaccgcctacatggaactggcccggctgaccagcgaggactccgccatctactactgcgcccggaacgacctgttcgcctattggggccagggcaccctcgtgacagtgtctgctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2118 - DNA, 3399 bp, Artificial Sequence
  Synthetic Polynucleotide encoding a CAR with optional accessory module(s)
atggccttaccagtgaccgccttgctcctgccgctggccttgctgctccacgccgccaggccggacatcaagatgacccagagccccagctctatgtacgccagcctgggcgagcgcgtgaccatcacctgtaaagccagccccgacatcaacagctacctgagctggttccagcagaagcccggcaagagccccaagaccctgatctaccgggccaacagactggtggatggcgtgcccagcagattctctggcggcggaagcggccaggactacagcctgaccatcaactccctggaatacgaggacatgggcatctactactgcctccagtacgacgagttcccctacaccttcggcggaggcaccaagctggaaatgaaaggcggaggcggaagtggaggcggaggatctggcggcggaggctctgaagtgaagctggtggaatcaggaggaggcctcgtgaaacctggcggctctctgaagctgagctgtgccgccagcggcttcaccttcagcagctacgccatgagctgggtgcgccagattcccgagaagcggctggaatgggtggcctccattagcagaggcggcaccacctactaccccgacagcgtgaagggccggttcaccatctccagagacaacgtgcggaacatcctgtacctccagatgagcagcctgcggagcgaggacaccgccatgtactactgcggcagatacgactacgacggctactacgctatggactactggggccagggcaccagcgtgaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2119 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccggacgacgtggtcgtgacccctgtgtcctgcttcctgagctgcatctctggcgccgagggccaccacctgattcagggccagcagaagtgccagtacatctggctgctgtacgccctggaacccaccgagacaagaaccgccacccagacccctcacctgtcctgcatccagcccagaatctggggaccctgccaggtgcagtggcagtgggtgtgggatagactgcacccccagcaccctagttgtggcggcggaggctgttgcaacctgctgctgtctgcccacggcgcctacacatttggcggaggcacccggctggaactgaaaggcggaggcggaagtggaggcggaggatctggcggcggaggctctgaagtgaagctccaggaaagcggccctgagctcgtgaagcctggcgcctctgtgaagatgagctgcaaggccagcggctacaccttcaccagctacgtgatgcactgggtcaagcagaagcccggccagggcctggaatggatcggctacatcaacccctacaacgacggcaccaagtacaacgagaagttcaagggcaaggccaccctgaccagcgacaagagcagcagcaccgcctacatggaactgagcagcctgacctccgaggacagcgccgtgtactactgcgcccggtggaaaatctactacggcaactacgaggactactggggccagggcacacccctgacagtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2120 - DNA, 3498 bp, Artificial Sequence
  Synthetic Polynucleotide encoding a CAR with optional accessory module(s)
atggccttaccagtgaccgccttgctcctgccgctggccttgctgctccacgccgccaggccggacgaattccaggtgcaactggtgcagtctggcggagggctggtgcagccagggggatctctgagactgagctgtgccgccagcgacttcgacttcgccgcctacgagatgagctgggtgcgccaggctcctggacagggactggaatgggtggccatcatcagccacgacggcatcgacaagtattacaccgacagcgtgaagggccggttcaccatcagccgggacaacagcaagaacaccctgtacctgcagatgaataccctgcgggccgaggacaccgccacctactattgcctgagactgggagccgtgggccagggcacacttgtgacagtgtctagcctcgagggaggaggcggctccgggggaggcggaagtggaggcggaggatctgggtctggaggaagcggatctggaggctcagggtcagggggctcaggcagtggaggcagcttcgaacaggtgcaactggtgcagagcggaggcggactggtgcagcctgggggcagtctgaggctgtcttgtgccgcctccgatttcgccttcgatgattacgagatgtcttgggtgcggcaggccccaggcaaagccctggaatggatcggcgacatcaaccacagcggcaccaccatctacaaccccagcctgaagtccagagtgaccatctccagagacaactccaagaatactctgtacctgcagatgaacacactgagagccgaagatacagccatctactactgcgccagaccccactacggcgactacagcgacgccttcgacatctggggccagggaaccatggtcaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2121 - DNA, 3423 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtccgtgtctccaggcgaaagagccaccctgagctgtagagccagccagagcgtgtccagcaacctggcctggtatcagcagaagcccggccaggctccccggctgctgatctatggcgcttctaccagagccaccggcatccccgccagattttctggcagcggctccggcaccgacttcaccctgacaatcagctccctccagtccgtggacagcgccgtgtactactgccagcagtacaacaactggcccccctacaccttcggccagggcaccaagctggaaatcaagggcggaggcggaagtggaggcggaggatctggcggcggaggctctcaggtgcaactgctggaaagcggagggggcgtggtgcagcctggaagaagcctgagactgagctgtgccgccagcggcttcaccttcagcttctacggaatgcactgggtgcgccaggcccctggcaaaggactggaatgggtggccgccatcagctacgacggcagcaacaagtattacgccgacagcgtgaagggccggttcaccatcagccgggacaacagcaagaacaccctgtacctccagatgaacagcctgcgggccgaggacacagccgtgtattattgcgccaagcggcccaaccagttctactgctccgacggcagatgctacagcatcgactactggggccagggaaccctcgtgaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2122 - DNA, 3411 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctcctagtgcctctgccggcggaacacctggacagagagtgaccatctcctgctccggcagcagcagcaacatcggcagcaacttcgtgtactggtatcagcaactgcccggcaccgcccccaagctgctgatctacagaaacaaccagcggcccagcggcgtgcccgatagattctctggaagcagaagcggcaccagcgccagcctggctggactgagaagcgaggacgaggccgactactactgtgccgccgatagcctgggcggccactacgtgttcggcaccggaacaaaagtgctgggcggaggcggaagtggaggcggaggatctggcggcggaggctctcaggtgcaactggtggaatctggcggaggctctgtgcagcctggcagaagcctgagactgagctgtgaagcctccggcttcaccttcgaggcttacgccatgcactgggtgcgccagccacctggcaaaggactggaatgggtgtccagcatcaactggaacagcggcagaatcgcctacgccgacagcgtgaagggccggttcaccatcagccgggacaacgccagaaacagcctgtacctccagatgaacagcctgcggctggaagataccgccttctactactgcgccaaggacatccggcggttcagcacaggcggagccgagtttgagtattggggccagggcaccctcgtgaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2123 - DNA, 3396 bp, Artificial Sequence
  Synthetic Polynucleotide encoding a CAR with optional accessory module(s)
atggccttaccagtgaccgccttgctcctgccgctggccttgctgctccacgccgccaggccggagaacgtgctgacacagagccctgccatcatgagcgcttccccaggcgagaaagtgaccatgacatgtagcgccagcagcagcgtgtcctacatgcactggtatcagcagaagtccagcacaagccccaagctgtggatctacgacaccagcaaactggcctctggcgtgccaggcagattttctggcagcggcagcggaaacagctacagcctgacaatcagcagcatggaagccgaggacgtggcaacctactactgctttcaaggcagcggctaccctctgacctttggagccggaacaaagctggaactgaaaggcggaggcggaagtggaggcggaggatctggcggcggaggctctcaggtgcagctgaaagaatctggccctggactggtggcccctagccagtctctgagcatcacctgtaccgtgtccggcttcagcctgagttctcagggcgtgtactgggtccgacagcctcctggaaaaggactggaatggctgggagccatttgggctggcggcagcaccaattacaacagcgccctgatgagccggctgagcatctccaaggacaacagcaagagccaggtgttcctgaagatgaacagcctccagaccgacgacaccgccatgtactactgcgccagagtggatggctaccggggctacaacatggactattggggccagggcaccagcgtgacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2124 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgacgccagcaacctggaaaccggcgtgcccagcagattttccggcagcggctctggcaccgacttcaccttcaccatcagctccctccagcccgaggacattgccacctactactgccagcagtacgacaacctgcccctgacctttggcggaggcaccaaggtggacatcaagagaggcggaggcggaagtggaggcggaggatctggcggcggaggctctcaggtgcaactggtggaatctggcggcggagtggtgcagcctggcagaagcctgagactgagctgtgccgccagcggcttcacctttagcagctacgccatgcactgggtgcgccaggcccctggaaaaggcctggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgtgccagggctcacaacagcagctcttggagcttcgactactggggccagggcaccctcgtgaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2125 - DNA, 3435 bp, Artificial Sequence
  Synthetic Polynucleotide encoding a CAR with optional accessory module(s)
atggccttaccagtgaccgccttgctcctgccgctggccttgctgctccacgccgccaggccggacgacgtcgtgatgacccagagccctctgagcctgcctgtgtccctgggcgatcaggccagcatctcctgcagatccagccagagactggtgcacagcaacggcaacacctacctgcactggtatctgcagaagcccggccagagccccaagctgctgatctaccgggtgtccaacagattccccggcgtgcccgatagattcagcggctctggcagcggcaccgacttcaccctgaagatcagccgggtggaagccgaggacctgggcatctatttctgcagccagagcacccacgtgccctacacctttggcggaggcaccaagctggaaatcaagcggggcggaggcggaagtggaggcggaggatctggcggcggaggctctgaagtgcggctgcagcagtctggccccgacctgattaagcctggggccagcgtgaagatgagctgcaaggccagcggctacaccttcaccggctacgtgatgcactgggtcaagcagaggccaggccagggcctggaatggatcggcttcatcaacccctacaacgacgacatccagagcaacgagcggttccggggcaaggccaccctgaccagcgataagagcagcaccaccgcctacatggaactgagcagcctgacctccgaggacagcgccgtgtactactgtgctaggggagccggctacaacttcgacggggcctacagattcttcgacttttggggccagggcaccacactgaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2126 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccggacagctacgagctgacccagcctcctagcgtgtccgtgtctcctggacagaccgccaccatctcttgcagcggcgatcaactgggcgggaagtacggccactggtatcagaagaagcccggccagagccccgtgctggtgctgtaccaggacagaaaacggcctgccggcatccccgagagattcagcggaagcagcagcggcaacaccatcaccctgaccatcagcggcacccaggccgtggatgaggccgactactactgccaggcttgggacaccaatctgggcggcgtgttcggcggaggcaccaaagtgacagtgctgggacagggcggaggcggaagtggaggcggaggatctggcggcggaggctctcaggtgcaactggtggaaagcggagccgaagtgaagaaacctggggccagcgtgaaggtgtcctgcaaggccagcggctacacctttaccggctactacatgcactgggtgcgccaggctccaggccagggactggaatggatgggccggatcaaccccaatagcggcggcaccaactacgcccagaaattccagggcagagtgaccatgaccagagacaccagcatcagcaccgcctacatggaactgagccggctgagaagcgacgacaccgccgtgtactactgcgccagccctagaggcagaggcagcgccttcgatatttggggccagggcacactcgtgaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2127 - DNA, 3417 bp, Artificial Sequence
  Synthetic Polynucleotide encoding a CAR with optional accessory module(s)
atggccttaccagtgaccgccttgctcctgccgctggccttgctgctccacgccgccaggccggacaacttcatgctgacccagccccacagcgtgtccgagagccctggcaagaccgtgaccatctcctgcaccagaagcagcggctctatcgccagcaaatacgtgcagtggtatcagcagaggcccggcagcagccctaccaccgtgatctacgaggacaaccagaggcctagcggcgtgcccgatagattcagcggcagcatcgacaccagcagcaacagcgccagcctgaccatcagcggcctgagaacagaggacgaggccgactactactgccacagctacgacagcaacaaccactccgtgttcggcggaggcaccaaagtgacagtgctgggacagggcggaggcggaagtggaggcggaggatctggcggcggaggctctgaagtgcaactggtggaaagcgggggaggcgtggtgcagccaggcggatctctgagactgagctgtgccgccagcggcttcaccttcagcagctacgccatgagctgggtgcgccaggcccctggaaaaggcctggaatgggtgtccgccatctctggctctggcggcagcacctactacgccgatagcgtgaagggccggttcagcatcagccgggacaacagcaagaacaccctgtacctccagatgaacagcctgcgggccgaggacaccgccgtgtactactgtgccagaaccagaagctccggggccttcgacatctggggccagggaacactcgtgaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2128 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggacatccagatgaaccagagccccagcagcctgagcgccagcctgggcgataccatcaccatcacctgtcacgccagccagaacatcaacgtgtggctgagctggtatcagcagaagcccggcaacatccccaagctgctgatctacaaggccagcaacctgcacaccggcgtgcccagcagattttctggcagcggctctggcaccggcttcaccattaccatcagctccctccagcccgaggacattgccacctactactgccagcagggccagagctacccctggacatttggcggaggcaccaagctggaaatcaagagaggcggaggcggaagtggaggcggaggatctggcggcggaggctctgaagtgcaactccagcagagcggcccagagcttgtgaagcctggcgcttccgtgaagattagctgcaaagccagcggctacagcttcaccggctacttcatgaactgggtcaagcagagccacggcaagagcctggagtacatcggcagattcaacccctacaacggcgagacactgtacaaccagaagttcaagggcaaggccaccctgaccgtggacaagagcagcagcaccgtgcacatggaactgctgagcgtgaccagcgaggacagcgccgtgtactactgtggcagaagcggcaacgacgacgctatggactattggggccagggcaccagcgtgaccgtgtctagtgctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2129 - DNA, 3405 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcatcctgagcgccagcgtgggcgacagagtgaccatcacctgtcgggccagccagagattcggcgactacctggcctggtatcagcagaagcctggacaggcccccaagctgctgatctacggcgcttccacactccagagcggcgtgcccagcagattttctggcagcggctccggcaccgagttcaccctgacaatcagcggcctccagcccgaggacttcgccacctactattgccagcaggccaacagcttccctatcaccttcggcaagggcacccggctggacatcagaagaggcggaggcggaagtggaggcggaggatctggcggcggaggctctcaggtgcagctggtgcagtctggggccgaagtgaagaaacccggcagcagcgtgaaggtgtcctgcaaggcttccggcggcaccttcagcagctacgccatttcttgggtgcgccaggccccaggacagggcctggaatggatgggctggatcaacgtgggcaacggcaacgccatctacagccagaaattccagggccgcgtgacaatcaccagagacaccagcgccaccaccgcctacatggaactgagcagcctgcggagcgaggacaccgccgtgtactactgtgccagggatggcgagagagcctgggacctggattattggggccagggcacactcgtgaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2130 - DNA, 3420 bp, Artificial Sequence
  Synthetic Polynucleotide encoding a CAR with optional accessory module(s)
atggccttaccagtgaccgccttgctcctgccgctggccttgctgctccacgccgccaggccggacgagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctacacattcggccagggcaccaagctggaaatcaagagaggcggaggcggaagtggaggcggaggatctggcggcggaggctctcaggtgcaactggtgcagtctggcggcggagtggtgcagcctggaagaagcctgagactgtcctgtgccgccagcggcttcaccttcagcagctacgccatgcactgggtgcgccaggcccctggaaaaggactggaatgggtggccgtgatctcctacgacggcagcaacaagtattacgccgacagcgtgaagggccggttcaccatctccagagacaacagcaagaacaccctgtacctccagatgaacagcctgcgggccgaggacacagccgtgtattattgcgccagagagctgcggttcctggaatggtccagcgacgccttcgacatctggggccagggaacaatggtcaccgtgtcctccacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2131 - DNA, 3405 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctgccaccctgtctctgagccctggcgaaagagccaccctgagctgtagagccagccagagcgtgcggagctacctggcctggtatcagcagaagcctggacaggcccccagactgctgatctacgacgccagcaatcgggccacaggcatccccgccagattttctggctctggcagcggcaccgacttcaccctgacaatcagcagcctggaacccgaggacttcgccgtgtactactgccagcagcggagcaactggccccctacctttggacagggcaccaaggtggaaatcaagggcggaggcggaagtggaggcggaggatctggcggcggaggctctcaactccaggtgcaggaatctggccccggactcgtgaagcccagcgagacactgagcctgacctgtaccgtgtccggcggcagcatcagcaacagctacttctcctggggctggatcagacagccccctggcaagggcctggaatggatcggcagcttctactacggcgagaaaacctactacaaccccagcctgaagtccagagccaccatcagcatcgacaccagcaagagccagttctccctgaagctgagcagcgtgacagccgccgacaccgccgtgtattattgccccagaggccccaccatgatccggggcgtgatcgactcttggggccagggaacactcgtgaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2132 - DNA, 3396 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggtgccgaagtgcggaagcctggcagctctgtgaaggtgtcctgtaaagcctccggcggcagcttcaacaactaccccatcttctgggtccgacaggcccctggacagggctttgaatggatgggcagaatcatccccatcctgggcatcaccgcctacgctcagaaattccagggccgcgtgacaatcaccgccgacaagtctacaagcacagcctacatggaactgaacagcctgcggagcgaggacaccgccgtgtattattgtgccggcggagatgacctggacgcctttgacatttggggccagggaacaatggtgtccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2133 - DNA, 3432 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacccccctgagcctgcctgtgacacctggcgagcctgccagcatctcctgcagaagcagcagaagcctgctggacagcgacgacggcaacacctacctggactggtatctgcagaaacccggccagagcccccaactgctgatctacaccctgagctacagagccagcggcgtgcccgatagattttccggctctggcagcggcaccgacttcaccctgaagatcagccgggtggaagccgaggacgtgggcgtgtactactgtatgcagcgggtggaatttcccatcaccttcggccagggcaccagactggaaatcaagagaggcggaggcggaagtggaggcggaggatctggcggcggaggctctcaggtgcaactggtggaatctggcgggggagtggtgcagcctggcagatccctgagactgagctgtgccgccagcggcttcatcttcagcagatacggaatgcactgggtgcgccaggcccctggcaagggactgaaatgggtggccgtgatttggtacgacggcagcaacaagctgtacgccgacagcgtgaagggccggttcaccatcagcagagacaacagcaagaacaccctgtacctgcagatgaacagcctgcgggccgaggacaccgccgtgtactattgcgccagagactactacgacaacagccggcaccactggggcttcgactattggggccagggaacccttgtgaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2134 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggagatccagatgacccagagccccagcagcatgtctgccagcctgggcgacaccatcaccatcacatgccaggccacccaggacatcttcaagaacctgaactggtatcagcagaagcccggcaagccccccagcctgctgatctactatgccaccgaactggccgagggcgtgcccagcagattttctggcagcggcagcggctccgactacagcctgaccatcagcaacctggaaagcgaggacttcgccgcctactactgcctccagttcttcgagttcccattcaccttcggctccggcaccaagctggaaatgaagggcggaggcggaagtggaggcggaggatctggcggcggaggctctcaggtgcaactccagcagtctggcgctgagcttgtgcggcctggcacctctgtgaaggtgtcctgtaaagccagcggctacgtgttcaccaactactggatcgagtggatcaagcagcggccaggccagggcctggaatggatcggcgtgatgaatccaggcagcggcgagacaacctacaacgagaagttcaagggcaaggccaccctgaccgccgacaagagcagcagcacagcctacatgcaactgtcctccctgaccagcgtggacagcgccgtgtacttctgcgccagggaccacgaccgggactactacgctatggactactggggccagggcaccagcgtgaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2135 - DNA, 3393 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacacagagccccgccatcctgtccgtgtctccaggcgagagagtgtcctttagctgccgggccagccagaacatcggcaccagcatccactggtatcagcagcggaccaacggcagccccagactgctgattaagtacgccagcgagtccgtgtccggcatccccagcagattttctggcagcggctccggcaccgacttcaccctgagcatcaacagcgtggaaagcgaggacattgccgactactactgccagcacaccaatagctggcccaccacctttggcggaggcaccaagctggaaatcaagagaggcggaggcggaagtggaggcggaggatctggcggcggaggctctcaggtgcaactccagcagtccgacgccgagcttgtgaagcctggcgcttccgtgaagattagctgcaaggccagcggctacaccttcaccgaccacgccattcactgggtcaagcagaagcccgagcagggcctggaatggatcggctacttcagccccggcaacggcgacatcaagtacaacgagaagttcaagggcaaggccaccctgaccgccgacaagagcagcagcacagcctacatgcaactgaacagcctgaccagcgaggactccgccgtgtacttctgcaagcggagctacggcaactacgactactggggccagggcaccacactgaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2136 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgcaagagcagccagagcctgctgaacagcggcgaccagaagaactacctgacctggtatcagcagaagcccggccagccccccaagctgctgatctactgggccagcaccagagaaagcggcgtgcccgatagattcagcggcagcggaagtggcaccgacttcaccctgaccatcagttctcttcaggccgaggacgtggccgtgtactactgccagaacgactacagctaccccctgaccttcggccagggcaccaaggtggaaatcaagggcggaggcggaagtggaggcggaggatctggcggcggaggctctcaggtgcagctggtgcagtctggggccgaagtgaagaaaaccggcagcagcgtgaaggtgtcctgcaaggccagcggctacacctttaccgaccacgccattcacgtgtggcggcaggctccaggacaggccctggaatggatgggccacttcagccccggcaacaccgacatcaagtacaacgacaagttcaagggcagagtgaccctgaccgtggaccgcagcatgagcaccgcctacatggaactgagcagcctgcggagcgaggacaccgccatgtactattgcaagaccagcaccttctttttcgactactggggccagggaacaatggtcaccgtgtccagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2137 - DNA, 3174 bp, Artificial Sequence
  Synthetic Polynucleotide encoding a CAR with optional accessory module(s)
atggagctgactgaattgctcctcgtggtcatgcttctcctaactgcaaggctaacgctgtccagcccggctcctcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggaccctaatgccatcttcctgagcttccaacacctgctccgaggaaaggtgcgtttcctgatgcttgtaggagggtccaccctctgcgtcaggcgggccccacccaccacagctgtccccagcagaacctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2138 - DNA, 3405 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgtccattgccgtggcctggtatcagcagaagcccggcaaggcccccaaggtgctgatctacagcgccagctacagatacaccggcgtgcccgacagattcagcggctctggcagcggcaccgacttcaccttcaccatcagctccctccagcccgaggatattgccgtgtactactgccagcagcactacatcacccccctgacctttggcggaggcaccaaggtggaaatcaagggcggaggcggaagtggaggcggaggatctggcggcggaggctctcagatccaactggtgcagagcggccacgaagtgaagaaacctggggccagcgtgaaggtgtcctgcaaagccagcggctacacctttaccaactacggcatgaactgggtgcgccaggcccctggacagggcctggaatggatgggctggatcaacaccaagaccggcgagcccacctacgccgaagagttcaagggcagattcgtgttcagcctggaaaccagcgcctccaccgcctacctccagatcagctctctgaaggccgaggacaccgccatgtacttttgcggcagaggcggctacggcagcagctactggtacttcgatgtgtggggccagggcaccaccgtgaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2139 - DNA, 3411 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgccgggccagcaagagcgtgtccaccagcggctacagctacatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagagctgccctacaccttcggccagggcaccaagctggaaatcaagggcggaggcggaagtggaggcggaggatctggcggcggaggctctcaggtgcaactccaggaatctggccctggccttgtgaagcccagcgagacactgagcctgacctgtaccgtgtccggcggcagcatcagctcttacggcgtgcactggattcggcagcctccaggcaagggcctggaatggatcggcgtgatctggacctccggcgtgaccgactacaacagcgccctgatgggcagagtgaccatctccgtggacaccagcaagaaccagttcagcctgaagctgagcagcgtgacagccgccgataccgccgtgtattattgcgccagagatggcgactacgaccgctacacaatggactactggggccagggaacccttgtgaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2140 - DNA, 3348 bp, Artificial Sequence
  Synthetic Polynucleotide encoding a CAR with optional accessory module(s)
atgacagccctgttcctgatgtccatgctgttcggcctggcctgcggacaggccatgtctttctgtatccccaccgagtacaccatgcacatcgagagaagagagtgcgcctactgcctgaccatcaacaccacaatctgcgccggctactgcatgacacgggatattaacggcaagctgttcctgcctaagtacgccctgagccaggacgtgtgcacctaccgggacttcatctaccggaccgtggaaatccctggctgccctctgcatgtggccccttactttagctaccccgtggctctgagctgcaagtgcggcaagtgcaacaccgactacagcgactgtatccacgaggccatcaagaccaactactgcaccaagcctcagaaaagctacctcgtgggcttctctgttggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2141 - DNA, 3399 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctcctagcgtgtccgtgtctcctggccagaccgccagcatcacctgtagcggcgataagctgggcgataagtacgcctgctggtatcagcagaagcccggccagtctcccgtgctcgtgatctaccaggacagcaagaggcccagcggcatccccgagagattcagcggcagcaacagcggcaataccgccaccctgaccatcagcggcacccaggctatggacgaggccgactactactgccaggcttgggatagcagcaccgccgtggtgtttggcggaggcaccaagctgacagtgctgggcggaggcggaagtggaggcggaggatctggcggcggaggctctcaggtgcagctggtgcagtctggggccgaagtgaagaagcctggacagagcctgaagatcagctgcaaggccagcggctacagcctgaccgacaactggattggctgggtgcgccagaagccaggcaagggcctggaatggatgggcatcatctaccccggcgacagcgacaccagatacagccctagcttccagggccaagtgaccatctccgccgacaagagcatcaacaccgcctacctccagtggtccagcctgaaagcctccgacaccgccatctactactgtgtgggactggactggaactacaaccccctgcggtactggggacctggcacactcgtgaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2142 - DNA, 3393 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccagaaattcatgagcaccagcgtgggcgaccgggtgtccatcatctgcaaggccagccagaacgtgggcaccttcgtggcctggtatcagcagaagcctggccagagccccaagctgctggtgtacagcgccagcaacagatacaccggcgtgcccgatagattcaccggcagcggctctggcaccgacttcaccctgaccatcaacaacatgcagagcgaggacctggccgactacttctgtcggcagtacagcagctacccctacaccttcggcggaggcaccaagctggaaatcaagggcggaggcggaagtggaggcggaggatctggcggcggaggctctgaagtgcaactccagcagagcggccctgagcttgtgaagccaggggccagcatgaagattagctgcaaagccagcggctacagcttcagcgcctacaccatgaactgggtcaagcagagccacggcaagaacctggaatggatcggcctgattaacccctacaacggcggcaccaactacaaccaggaatttgagggcaaggccaccctgacagtgaacaagagcagcaacaccgccttcatggaactgctgagcctgaccagcgacgacagcgccgtgtactactgcgccagacgggactgggactacttcgactattggggccagggcaccacactgaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2143 - DNA, 3426 bp, Artificial Sequence
  Synthetic Polynucleotide encoding a CAR with optional accessory module(s)
atggccttaccagtgaccgccttgctcctgccgctggccttgctgctccacgccgccaggccggccatccagatgacccagagccctagcagcctgagcgccagcgtgggcgacagagtgaccatcacctgtagagccagccagagcatcagcaactacctgaactggtatcagcagaagcccggcaaggcccccaagctgctgatctatgccgccagctctctccagagcggcgtgcccagcagattttctggcagcggctccggcaccgacttcaccctgacaatcagcagcctccagcccgaggacttcgccacctactactgccagcagagctacagcagcccctccaccacctttggacagggcaccaagctggaaatcaagagaggcggaggcggaagtggaggcggaggatctggcggcggaggctctgaagtgcagctggtggaatctggcggcggactgattcagcctggcggctctctgagactgagctgtgccgcctctggcttcaccgtgtcctccaactacatgagctgggtgcgccaggcccctggcaagggactggaatgggtgtccgtgacatacagcggcggcagcaccagctacgccgatagcgtgaagggccggttcaccatcagccgggacaacagcaagaacaccctgtacctccagatgaacagcctgcgggccgaggacaccgccgtgtactattgtgccaggggaggccggtactgctccagcatcagctgctatgccagaagcggctgcgactactggggccagggaacactcgtgaccgtgtccagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2144 - DNA, 3411 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcggcaccagcctgcactggtatcagcagaagcctggcaaggcccccaagctgctgattaagttcgccagcagactgcagagcggcgtgcccagcagattttctggcagcggctccggcaccgacttcaccctgacaatcagctccctgcagcccgaggacttcgccacctactactgccagcagagccccggcttccctccaacctttggacagggcaccaagctggaaatcaagcggggcggaggcggaagtggaggcggaggatctggcggcggaggctctcaggtgcaactggtggaatctggcggcggacttgtgaagccaggcggcagcctgagactgagctgtgccgccagcggcttcagcatcaccaccagcggctactactggacctggatcagacagttccccggcaagggcctggaatggatgggctacatcggctacaacagcaagacctactacaaccccgccctgaagtcccggatcaccatcagcagagacaacgccaagaacagcctgtacctgcagatgaactccctgagagccgaggataccgccgtgtactactgcgccagatccctgtacggcggctacaaggacgccttcgatagctggggccagggaacccttgtgaccgtgtctagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2145 - DNA, 3426 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacccagagccctctgagcctgcctgtgacacctggcgagcctgccagcatctcctgtagaagcagccagagcctgctgcacagcatcggctacaactacctggactggtatctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagacccccctgacctttggcggaggcaccaaggtggaaatcaagcggggcggaggcggaagtggaggcggaggatctggcggcggaggctctgaagtgcaactggtggaaagcggaggcggcgtggtgcagcctggaagaagcctgagactgagctgtgccgccagcggcttcaccttccggtcctacggaatgcactgggtgcgccaggcccctggcaaaggactggaatgggtggccgtgatctcctacgacggctccaacaagtactacaccgacagcgtgaacggcagattcaccatcagcagagacaacagcaagaacaccctgtacctccagatgaacagcctgcgggccgaggacaccgccgtgtactattgtgctagaggcggaggctactacgagacaagcggccctgattactggggccagggcacactcgtgaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2146 - DNA, 3420 bp, Artificial Sequence
  Synthetic Polynucleotide encoding a CAR with optional accessory module(s)
atggccttaccagtgaccgccttgctcctgccgctggccttgctgctccacgccgccaggccggacgacgtcgtgatgacccagagccctctgagcctgcctgtgacacctggcgagcctgccagcatctcctgtagaagcagccagagcctgctgcacagcatcggctacaactacctgcactggtttctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagacccctcccacctttggacagggcaccagactggaaatcaagcggggcggaggcggaagtggaggcggaggatctggcggcggaggctctcaactccaactccaggaaagcggccctggcctcgtgaagcctagcggcacactgagcctgacatgtgccgtgtctggcggcagcatcagcagcagcaactggtggtcttgggtgcgccagcctcctggcaagggcctggaatggatcggcgaaatctaccacagcggcagcaccaactacaaccccagcctgaagtccagagtgaccatcagcgtggacaagagcaagaaccagttctccctgaagctgagcagcgtgacagccgccgataccgccgtgtactattgcgtgggcagcccctacggcgactacgtgctggattattggggccagggcaccctcgtgaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2147 - DNA, 3429 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagagccctctgagcctgcctgtgacacctggcgagcctgccagcatcagctgtagaagcagccagagcctgctgcacagcaacggccacaactacctggactggtatctccagaagcccggccagagcccccagctgctgatctacctgggcagcaatagagccagcggcgtgcccgatagattcagcggctctggaagcggcaccgacttcaccctgaagatcagccgggtggaagccgaggacgtgggcgtgtactactgtatgcagaccctccagacccccctgacctttggccctggcaccaaggtggacatcaagagaggcggaggcggaagtggaggcggaggatctggcggcggaggctctgaagtgcagctggtggaaacaggcggaggcgtggtgcagcctggcagaagcctgagactgagctgtgccgccagcggcttcaccttcagcagctacggaatgcactgggtgcgccaggcccctggcaaaggactggaatgggtggccgtgatctcctacgacggcagcaacaagtattacgccgacagcgtgaagggccggttcaccatctccagagacaacagcaagaacaccctgtacctccagatgaacagcctgcgggccgaggacaccgccgtgtactattgcgccaaggacagatacggctggggcagcagcttcggccacttcgattattggggccagggcaccctcgtgaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2148 - DNA, 3414 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctggcaccctgagcctgtctctgggagagagagccacactgagctgtcgggccagccagtctatcagcagcagcttcctggcctggtatcagcagaagcccggccaggcccctaagctgctgatctacgccgccagcacaagagccaccggcatccccgatagattcagcggctctggcagcggcaccgacttcaccctgaccatcagcagactggaacccgaggacttcgccgtgtactactgccagcagtacggcagaagcctgagcttcggcggaggcaccaaggtggaagtgaagggcggaggcggaagtggaggcggaggatctggcggcggaggctctcaggtgcaactccagcagtctggccccggactcgtgaagcctagccagacactgagcctgacctgcgccatcagcggcgatagcgtgtccggcaatagcgccacctggaactggatcagacagagcccatctcggggcctggaatggctgggccggacctactaccgcagcaagtggaaccacgactacgccgagagcgtgaagtcccggatcaccatcaaccccgacaccagcaagaaccagttctccttgcaactgaacagcgtgacccccgaggacacagccgtgtattattgcgccagaggcgacagcagctcttggtacgccttcgactattggggccagggcaccctcgtgaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2149 - DNA, 3414 bp, Artificial Sequence
  Synthetic Polynucleotide encoding a CAR with optional accessory module(s)
atggccttaccagtgaccgccttgctcctgccgctggccttgctgctccacgccgccaggccggaccagaccgtcgtgacacagcctcctagcgcctctggcacaccaggccagagagtgaccatctcctgtagcggcagcagcagcaacatcggcagcaactacgtgtactggtatcagcaactgcccggcaccgcccccaagctgctgatctacagaagcaaccagcggcccagcggcgtgcccgatagattttctggcagcaagagcggcaccagcgccagcctggctatctctggacctagaagcgtggacgaggccgactactactgcgccgcctgggacgatagcctgaacggcgtggtgtttggcggaggcaccaagctgacagtgctgggtggcggaggcggaagtggaggcggaggatctggcggcggaggctctcaggtgcaactggtgcagtctggggccgaagtgaagaaacccggcagctccgtgaaggtgtcctgcaaggcttccggcggcaccttcagcagctacgccatttcttgggtgcgccaggcccctggacagggcctggaatggatgggcggcatcatccccatctttggcaccgccaactacgcccagaaattccagggccgcgtgaccatcaccgccgacgagtctacaagcaccgcctacatggaactgagcagcctgcggagcgaggataccgccgtgtactactgtgccagaagaatccccccctactacggcatggacgtgtggggccagggaaccaccgtgaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2150 - DNA, 3414 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtcgtgacacagcctcctagcgtgtcagtggcccctggcaagaccgccagaatcacctgtggccggaacaacatcggcagcaagagcgtgcactggtatcagcagaagcccggccaggctcctgtgctggtggtgtacgacgacagcgacagacccagcggcatccccgagagattcagcggcagcaactccggcaataccgccaccctgaccatcagcagagtggaagccggcgacgaggccgactactactgccaagtgtgggacagcagcagcgatcacgtggtgtttggcggaggcaccaagctgacagtgctgggtggcggaggcggaagtggaggcggaggatctggcggcggaggctctgaagtgcaactggtgcagtctggcggaggggtcgtgcggcctggcggatctctgagactgtcttgtgccgccagcggcttcaccttcgacgactacggcatgagctgggtgcgccaggcccctggaaaaggcctggaatgggtgtccggcatcaactggaatggcggcagcaccggctacgccgattctgtgcggggcagattcaccatcagccgggacaacgccaagaacagcctgtacctgcagatgaactccctgcgggccgaggacaccgccctgtactattgcgccagagagcggggctacggctaccacgaccctcacgattattggggccagggcacccttgtcaccgtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2151 - DNA, 3450 bp, Artificial Sequence
  Synthetic Polynucleotide encoding a CAR with optional accessory module(s)
atggccttaccagtgaccgccttgctcctgccgctggccttgctgctccacgccgccaggccggaacagaaactcatcagtgaagaagacctggaattccaggctgtcgtgacacagcctcctagcgcctctggcacaccaggccagagagtgaccatctcctgtagcggcagcagcagcaacatcggcagcaacaccgtgaactggtatcagcaggtgcccggcaccgctcccaagctgctgatctacagcaacaaccagcggcccagcggcgtgcccgatagattttctggcagcaagagcggcaccagcgccagcctggctatctctggactccagtccgaggacgaggccgactactattgcgccgcctgggacgatagcctgaacggctgggtgttcggcggaggcaccaagctgacagtgctgggcggaggcggaagtggaggcggaggatctggcggcggaggctctcagatgcaactggtgcagagcggagccgaagtgaaagagcctggcgagagcctgcggatctcctgcaagggcagcggctacagcttcaccaatttctggatctcttgggtgcgccagatgcccggcaagggcctggaatggatgggcagagtggaccccggctactcctacagcacctacagccctagcttccagggccacgtgaccatcagcgccgacaagagcaccagcaccgcctacctccagtggaacagcctgaaggccagcgacaccgccatgtactactgcgccagagtgcagtacagcggctattacgattggttcgacccctggggccagggcacactcgtgacagtgtcaagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2152 - DNA, 3432 bp, Artificial Sequence
  Synthetic Polynucleotide encoding a CAR with optional accessory module(s)
atggccttaccagtgaccgccttgctcctgccgctggccttgctgctccacgccgccaggccggaacagaaactcatcagtgaagaagacctggaattcgacatccagatgacccagagccccagcacactgagcgccagcgtgggcgacagagtgaccatcacctgtcgggccagccagaacatcaacaagtggctggcctggtatcagcagaggcccggaaaagccccccagctgctgatctacaaggccagcagcctggaaagcggcgtgcccagcagattttctggcagcggctctggcaccgagtacaccctgaccatcagctccctccagcccgacgacttcgccacctactactgccagcagtacaacagctacgccaccttcggccagggcaccaaggtggaaatcaagagaggcggaggcggaagtggaggcggaggatctggcggcggaggctctcaggtgcagctggtgcagtctggggccgaagtgaagaagcctggcgagagcctgaagatcagctgcaagggctccggctacaacttctctaacaagtggatcggctgggtgcgccagctgcctggcagaggactggaatggatcgccatcatctaccccggctacagcgacatcacctacagccccagcttccagggccgcgtgacaatcagcgccgacaccagcatcaacaccgcctacctgcactggcacagcctgaaggccagcgacaccgccatgtactactgcgtgcggcatacagccctggctggcttcgattattggggcctgggcaccctcgtgaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2153 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccaatacctacctggcctggtatcaccagaggcccggacaggctccccggctgctgatctatggcgcttctagcagagccaccggcatccccgatagattcagcggctctggcagcggcaccgacttcgccctgacaatcagctccctggaacccgaggacttcgccgtgtactactgccagcagtacagcaactcctggaccttcggccagggcaccaaggtggaaatcaagagaggcggaggcggaagtggaggcggaggatctggcggcggaggctctcaggtgcaactggtggaatctggcgggggagtggtgcagcctggcagaagcctgagactgtcttgtgccgccagcggcttcaccttcagcagctacgacatgcactgggtgcgccaggcccctggcaaaggactggaatgggtggccgtgatctcctacgacggcaccaacgagtattacgccgacagcgtgaagggccggttcaccatctccagagacaccagcaagaacaccctgtacctccagatgaacagcctgcgggccgaggacacagccgtgtattattgcgccagagagcggtacttcgactggtccttcgactactggggccagggaaccctggtgtccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2154 - DNA, 3399 bp, Artificial Sequence
  Synthetic Polynucleotide encoding a CAR with optional accessory module(s)
atggccttaccagtgaccgccttgctcctgccgctggccttgctgctccacgccgccaggccggagctgacacaggaccctgctgtgtctgttgccctgggccagacagtgcggattacctgtcaaggcgacagcctgagaagcaactacgccaactggtatcagcagaagcccggacaggctcccgtgctggttatctacggccagaacaacagacccagcggcatccccgatagattcagcggctctagctctggcaataccgccagcctgacaatcactggcgctcaggctgccgatgaggccgactactactgcgatagcagagtgtccaccggcaatcacgtggtgtttggcggcggaacaaagctgacagtgctcggacaaggcggaggcggaagtggaggcggaggatctggcggcggaggctctgaagttcagctggtgcagagcggagccgaagtgaagaaacctggggcctctgtgaaggtgtcctgcaaggcttccggctacacctttaccagctacgccatgcactgggtccgacaggcacctggacaacggcttgaatggatgggctggatcaacgccggcaacggcaacaccaagtacagccagaaattccagggccgcgtgaccatcaccagagatacaagcgccagcaccgcctacatggaactgtctagcctgagatccgaggacaccgccgtgtactactgtgccagagacatcagctacggcagcttcgactattggggccagggcacactggtcaccgttagctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2155 - DNA, 3405 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagacaccagccacactgagcgtgacacctggcgattctgtgtccctgagctgtagagccagccagagcatcagcaacaacctgcactggtatcagcagaagtcccacgagagccccagactgctgattaagaacgccagccagtctatcagcggcatccccagcaagtttagcggctctggcagcggcaccgacttcaccctgagaatcaacagcgtggaaaccgaggacttcgggatgtacttctgccagcagagcaatagctggccctacacatttggctccggcaccaagctggaaatcaaaggcggaggcggaagtggaggcggaggatctggcggcggaggctctcaagtgaagctgcaacagagcggacccgagctggttaagccaggcgcttccgtgaagattagctgcaaggccagcggctacagcttcaccggctactacatgcactgggtcaagcagagccacggcaacatcctggactggatcggctacatctacccctacaacggcgtgtccagctacaaccagaagttcaagggcaaagccactctgaccgtggacaagagcagcagcaccgcctacatggaactgagaagcctgaccagcgaggacagcgccgtgtactattgtgccagagagcggggcctgtaccagctcagagcaatggattattggggccagggcaccagcgtgaccgtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2156 - DNA, 3378 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacacagacccctgccatcatgagcgcctctccaggccagaaagtgaccatcacatgtagcgccagcagcagcgtgaactacatgcactggtatcagcagaagctgggcagcagccccaagctgtggatctacgataccagcaaactggcccctggcgtgccagccagattttctggttctggcagcggcaccagctacagcctgacaatcagcagcatggaagccgaggatgccgccagctacttctgccatcagtggtctagctacccctacacctttggctccggcaccaagctggaaatcaaaggcggaggcggaagtggaggcggaggatctggcggcggaggctctgaagttcagctccaagagtctggccccgacctggtcaagcctagccaaagcctgagcctgacctgtaccgtgaccggctacagcatcacaagcggctatggatggcactggatcagacagttccccggcaacaaactggaatggatgggctacatccactacagcggcagcaccacctacaatcccagcctgaagtcccggatcagcatcagcagagacaccagcaagaaccagttcttcctgcaactgaacagcgtgaccaccgaggacaccgccacctactattgtgctcggagcctgagatattggggccagggcacaaccctgaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2157 - DNA, 3387 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagcgccaccagcagcatcagctacatgcactggtatcagcagaagcccggcaaggcccctaaaggctggatctacgataccagcaaactggcccacggcgtgcccagcagattttctggttctggcagcggcaccgacttcaccctgacaatatctagcctccagcctgaggacttcgccacctactactgccaccagagaagaagctaccccttcaccttcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggcttccggctacacctttaccaatttctggattcactgggtccgacaggctccaggccaaggactggaatggatcggagagatcgaccccagcgacagctacaccaactacaaccagaaattcaaaggccgggtcaccatcaccagagacaccagcacaagcaccgcctacctggaactgagcagcctgagaagcgaggacaccgccgtgtactactgcgccagggaaatcaccaccgtggattattggggccagggaaccctggtcaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2158 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagccagggcttcaacaaatacgtggcctggtatcagcagaagcccggcaaggctcctaagctgctgatctactacaccagcacactccagcctggcgtgcccagcagattttctggctctggcagcggcagagactacaccctgacaatatccagcctccagccagaggacttcgccacctactactgtctccagtacggcaacctgctgtacgcctttggacagggcaccaaggtggaaatcaagagaggcggaggcggaagtggaggcggaggatctggcggcggaggctctgaagttcagcttgtgcagagcggagccgaagtgaagaaacctggggcctctgtgaaggtgtcctgcaaagccagcggctacacctttaccagctactggatcggctgggtccgacaggctcctggacaaggactggaatggatcggcgacatctatcccggcggaggctacaccaactacaacgagaagttcaagggccgcgtgacaatcaccagagacacctctacaagcaccgcctacctggaactgagcagcctgagaagcgaggacaccgccgtgtactactgcgccagactggatggcagcagctacagaggcgctatggattcttggggccagggcacactggtcaccgtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2159 - DNA, 3420 bp, Artificial Sequence
  Synthetic Polynucleotide encoding a CAR with optional accessory module(s)
atggccttaccagtgaccgccttgctcctgccgctggccttgctgctccacgccgccaggccggacatccagctcacacagagcccttctagcctgtctgccagcgtgggcgacagagtgaccatcacatgtagagccagccagagcgtggactacgacggcgacagctacatgaactggtatcagcagaagcccggcaaggcccctaagctgctgatctacgccgccagctatctggaaagcggcgtgccaagcagattttccggctctggcagcggcaccgatttcaccctgacaatatccagcctccagcctgaggacttcgccacctactactgccagcagagccatgaggacccctacacctttggacagggcaccaaggtggaaatcaagagaggcggaggcggaagtggaggcggaggatctggcggcggaggctctgaagtgcaactggttgaatctggcggcggactggttcagcctggcggatctctgagactgagctgtgccgtgtctggctacagcatcaccagcggctactcttggaactggatcagacaggcccctggcaaaggactggaatgggtcgcctccatcacctacgatggcagcaccaactacaaccccagcgtgaagggcagaatcaccatcagcagggacgacagcaagaacaccttctacctgcaaatgaacagcctgagagccgaggacaccgccgtgtactattgtgccagaggcagccactacttcggccactggcattttgctgtgtggggccagggaaccctggtcacagtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2160 - DNA, 3396 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccaggacatccggtactacctgaactggtatcagcagaagcccggcaaggcccctaagctgctgatctatgtggcctccagcctccagagcggagtgccttctagattttctggcagcggctccggcaccgagtttaccctgacagtgtctagcttgcagcccgaggacttcgccacctactactgcctgcaagtgtacagcacccctcggacctttggacagggcaccaaggtggaaatcaaaggcggaggcggaagtggaggcggaggatctggcggcggaggctctgaagtgcagcttgttgaatctggcggcggactggctaagcctggcggatctctgagactgtcttgtgccgccagcggcttccggttcaccttcaacaactactacatggactgggtccgacaggcccctggacaaggacttgaatgggtgtccagaatcagcagcagcggcgaccctacttggtacgccgattctgtgaagggcagattcaccatcagcagagagaacgccaagaacaccctgttcctccagatgaactccctgagagccgaggacaccgccgtgtactattgtgcctctctgaccaccggcagcgattcttggggacagggcgtgctggttaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2161 - DNA, 3399 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatcggaagcctccagagcgaggacttcgccgtgtactactgccagcagtacaagacctggcctcggacctttggacagggcaccaacgtggaaatcaaaggcggaggcggaagtggaggcggaggatctggcggcggaggctctcaagttcagctgcaacaatggggagccggcctgctgaagcctagcgaaacactgtctctgacctgcgccgtgttcggcggctctttcagcggctactactggtcctggatcagacagcctcctggcaaaggactggaatggatcggcgagatcaaccaccggggcaacaccaacgacaaccccagcctgaaaagcagagtgaccatcagcgtggacaccagcaagaaccagttcgccctgaagctgagcagcgtgacagccgctgataccgccgtgtattattgcgccagagagcggggctacacctacggcaatttcgatcactggggccagggcaccctggtcacagtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2162 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccctagcagcgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatctctagcctccagagcgaggacttcgccgtgtactactgccaccagtacagcaactggatgtgcagcttcggccagggcaccaagctggaaatcaaaggcggaggcggaagtggaggcggaggatctggcggcggaggctctgaagttcagctccttgagtcaggtggcggcctggttcaacctggcggatctctgagactgagctgtgccgccagcggcttcacctttagcagatacgccatgaactgggtccgacaggcccctggcaaaggactggaatgggtgtccggcatctctggaagcggcggcagaacctactacgccgattctgtgaagggcagattcaccatcagccgggacaacagcaagaacaccctgtacctccagatgaacagcctgagagccgaggacacagccgtgtattattgcgccaaggaccgggacttttggagcggcccttttgactattggggccagggaaccctggtcaccgttagctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2163 - DNA, 3402 bp, Artificial Sequence; identical to SEQ ID NO: 2162
  Synthetic Polynucleotide encoding a CAR with optional accessory module(s)

SEQ ID NO: 2164 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccgcaggttcagctccagcagtctgatgccgagctggtcaagcctggcagcagcgtgaagattagctgcaaggccagcggctacaccttcaccgatcacgccatccactgggtcaagcagaagcctgagcagggcctcgaatggatcggccactttagccctggcaacaccgacatcaagtacaacgacaagttcaagggcaaagccacactgaccgtggacagaagcagcagcacagcctacatgcagctgaacagcctgaccagcgaggacagcgccgtgtacttctgcaagaccagcaccttctttttcgactactggggccagggcacaaccctgacagtttcttctggcggaggcggaagtggaggcggaggatctggcggcggaggctctgaactggttatgacacagagccccagcagcctgacagtgacagccggcgagaaagtgaccatgatctgcaagtctagccagagcctgctgaactccggcgatcagaagaactacctgacctggtatcagcagaaacccggccagcctcctaagctgctgatcttctgggccagcaccagagaaagcggcgtgcccgatagattcacaggcagcggcagcggaaccgacttcaccctgacaatcagctctgtgcaggccgaggacctggccgtgtattactgccagaacgactacagctaccctctgacctttggagccggcaccaagctggaactgaagacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2165 - DNA, 3411 bp, Artificial Sequence
  Synthetic Polynucleotide encoding a CAR with optional accessory module(s)
atggccttaccagtgaccgccttgctcctgccgctggccttgctgctccacgccgccaggccggaggtgcaactggttgagtctggcggaggactggtgcagcctggaagaagcctgagactgtcttgtgccgccagcggcttcaccttcgacgattatgccatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactactgcgccaaagacaaaggcggaggctactacgacttttggagcggcagcgattattggggccagggcacactggtcacagtgtctagcggcggaggcggaagtggaggcggaggatctggcggcggaggctcttcttctgagctgacacaggaccctgccgtgtctgttgctctgggccagacagtgcggattacctgtcagggcgatagcctgagaagctactacgcctcctggtatcagcagaagccaggccaggctcctgtgctggtcatctacggcaagaacaacagacccagcggcatccccgatagattcagcggaagcagctctggcaataccgccagcctgacaattactggcgctcaggccgaggacgaggccgactactactgcaacagcagagatagcagcggctgggttttcggcggaggcacaaaactgacagtgctgacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2166 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccggaagtgcagctccagcagtctggacctggcctggttaagcctagccagacactgagcctgacctgtgccatcagcggcgatagcgtgctgagcaacagcgacacctggaactggatcagacagagccctagcagaggactggaatggctgggcagaacctaccacagaagcacttggtacgacgactacgccagctctgtgcggggcagagtgtccatcaatgtggacaccagcaagaaccagtacagcctgcaactgaacgccgtgacacctgaggataccggcgtgtactactgcgccagagacagactccaggacggcaactcttggagcgacgcctttgatgtgtggggccagggcacaatggtcaccgtttctagcggcggaggcggaagtggaggcggaggatctggcggcggaggctctcaatctgctctgacacagcctgccagcgtgtcaggatctcctggacagagcatcaccatctcttgcaccggcaccagctctgatgtcggcggctacaattacgtgtcctggtatcagcagcaccccggcaaggcccctaagctgatgatctacgacgtgtccaacagacccagcggcgtgtccaatagattctccggcagcaagagcggcaacaccgccagcctgacaatttctggactgcaagccgaggacgaggccgactactactgtagcagctacaccagcagcagcacactggtgtacgtgttcggcacaggcaccaaagtgaccgtgcttacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2167 - DNA, 3432 bp, Artificial Sequence
  Synthetic Polynucleotide encoding a CAR with optional accessory module(s)
atggccttaccagtgaccgccttgctcctgccgctggccttgctgctccacgccgccaggccgcaggtgcaactggttcagtctggggccgaagtgaagaaacctggggcctctgtgaaggtgtcctgcaaggcttccggctacacctttaccagctacgacatcaactgggtccgacaggccacaggccaaggactggaatggatgggctggatgaaccccaacagcggcaataccggctacgcccagaaattccagggcagagtgaccatgaccagaaacaccagcatcagcaccgcctacatggaactgagcagcctgagaagcgaggacaccgccgtgtactattgcgccagaggcgacagcaactactggtcctactacggcatggacgtgtggggccagggaacactggttacagtttctagcggcggaggcggaagtggaggcggaggatctggcggcggaggctctggcggtggtggatctcaatctgtgctgacccagcctagatccgtgtctggctctcctggacagagcgtgaccatctcttgtaccggcaccagctctgatgtcggcggctacaattacgtgtcctggtatcagcagcaccccggcgaagcccctaagctgattatctacgacgccgacaagcggcccagcggcatcagcaatagattcagctctggcaagagcggcaacaccgccagcctgacaatcagcggactccaggtggaagatgaggccgactactactgctgctcctatgccggcggaagcacctgggttttcggaggcggtacaaaagtgaccgtgctgacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2168 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccggaagtgcagctccagcagtctggacctggcctggttaagcctagccagacactgagcctgacctgtgccatcagcggcgatagcgtgtcctctaatagcgccgcctggaactggatcagacagagccctagcagaggactggaatggctgggcagaacctactaccgcagcaagtggtacagcgactacgccgtgtccgtgaagtcccggatcaccatcaatcccgacaccagcaagaaccagttcagcctgcaactgaacagcgtgacccctgaggataccgccgtgtactactgcgccagagatccctacgacttttggagcggctaccccgacgcctttgacatctggggacagggcacaatggtcaccgtttctagcggcggaggcggaagtggaggcggaggatctggcggcggaggctctcaatctgctctgacacagcctgccagcgtgtcaggatctcctggacagagcatcaccatctcttgcaccggcaccagctctgatgtcggcggctacaattacgtgtcctggtatcagcagcaccccggcaaggcccctaaagtgattatcagcgaagtgaacaacagacccagcggcgtgtcccacagattcagcggctctaagtctggcaacaccgccagcctgacaatctctggactgcaagccgaggacgaggccgactacttctgtagcagctacaccagcggcagaaccctgtacgtgttcggcacaggcagcaaagtgacagtgctgggaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2169 - DNA, 3435 bp, Artificial Sequence
  Synthetic Polynucleotide encoding a CAR with optional accessory module(s)
atggccttaccagtgaccgccttgctcctgccgctggccttgctgctccacgccgccaggccggaagtgcagctccagcagtctggacctggcctggttaagcctagccagacactgagcctgacctgtgccatcagcggcgattccatgctgagcaacagcgacacctggaactggatcagacagagccccagcagaggcctggaatggctgggcagaacataccacagaagcacttggtacgacgactacgccagctctgtgcggggcagagtgtccatcaatgtggacaccagcaagaaccagtacagcctgcaactgaacgccgtgacacctgaggataccggcgtgtactactgtgccagagtgcggctccaggacggcaattcttggagcgacgcctttgatgtgtggggccagggcacaatggtcaccgtttctagcggcggaggcggaagtggaggcggaggatctggcggcggaggctctcaatctgctctgacacagcctgccagcgcctctggatctcctggacagagcgtgaccatctcctgtaccggcacctcttctgatgtcggcggctacaactacgtgtcctggtatcagcagcaccccggcaaggcccctaagctgatgatctacgacgtgtccaacagacccagcggcgtgtccaatagattctccggcagcaagagcggcaacaccgccagcctgacaatttctggactgcaagccgaggacgaggccgactactactgtagcagctacaccagcagcagcacactgtacgtgttcggcacaggcacccagctcacagttcttacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2170 - DNA, 3408 bp, Artificial Sequence; identical to SEQ ID NO: 2164
  Synthetic Polynucleotide encoding a CAR with optional accessory module(s)

SEQ ID NO: 2171 - DNA, 3435 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctggaggcggtggaagtggcggcggtggttcaggcggcggaggatctcaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2172 - DNA, 3423 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtccatctacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcctcctttcacattcggccctggcaccaaggtggacatcaaaggcggaggcggaagtggaggcggaggatctggcggcggaggctctcaggtgcagcttgttgaaagcggaggcggagttgtgcagcctggcagaagtctgagactgtcttgtgccgccagcggcttcaccttcagcagctatggaatgcactgggtccgacaggcccctggcaaaggacttgaatgggttgccgtgatctgggacgacggcagcaacaagtattacgtggacagcgtgaagggcagattcaccatcagccgggacaacagcaagaacaccctgtacctccagatgaacagcctgagagccgaggacacagccgtgtattattgcgccagagatgactactacggcagcggctccttcaacagctactatggcacagacgtgtggggccagggcacaacagttaccgttagctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2173 - DNA, 3378 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctgaagtgcaactggttcaatctggcggcggactggttcatccaggcggttctctgagactgagctgtgccggctctggcttcaccttcagcacctacctgatgtactgggtccgacaggcccctggcaagacactggaatgggtgtccgctattggcagcggaggcgatacctactacgccgactctgtgaagggcagattcaccatcagccgggacaacgccaagaacagcctgtacctccagatgaactccctgagagccgaggacatggccgtgtactactgtgccagaggactcggctattggggccagggaacactggtcacagtgtcctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2174 - DNA, 3435 bp, Artificial Sequence
  Synthetic Polynucleotide encoding a CAR with optional accessory module(s)
atggccttaccagtgaccgccttgctcctgccgctggccttgctgctccacgccgccaggccgctgcctgttctgacacagcctccatccgtgtctgtggcccctggaaagaccgccagaatcacatgcggcggcaacaacatcggcagcaagagcgtgcactggtatcagcagaagcctggacaggctcctgtgctggtggtgtacgacgacagcgatagacctagcggcatccccgagagattcagcggcagcaattccggcaataccgccacactgaccatcagcagagtggaagctggcgacgaggccgactactactgccaagtgtgggacagcagcagcgactacgtggtgtttggcggcggaacaaagctgacagtgcttggcggaggcggaagtggaggcggaggatctggcggcggaggctctgaagttcaactggtgcagagcggagccgaagtgaagaagccaggcgagagcctgaagattagctgcaaaggcagcggctacagcttcaccagctactggatcggctgggtccgacagatgcctggcaaaggactggaatggatgggcatcatctaccccggcgacagcgacaccagatacagccctagctttcagggccaagtgaccatctccgccgacaagagcatcagcacagcctacctccagtggtcctctctgaaggccagcgataccgccatgtactactgcgccagacaagtctggggatggcaaggcggcatgtaccccaggtctaactggtggtacaacctggactcttggggccagggcacactggtcacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2175 - DNA, 3405 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctcctagtgtgtctggcgctcctggacagagagtgaccatcagctgtacaggcagcagcagcaatatcggagccggctatgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctctgtgtttggcacaggcacaaaggtgctggtgcttggcggaggcggaagtggaggcggaggatctggcggcggaggctctcaagttcagctggttcagagcggagccgaagtgaagaaacctggcagcagcgtgaaggtgtcctgcaaagcaagcggcggcaccttcagcagctacaccatcaacgtttggagacaggccccaggccagggccttgaatggatgggaggcttcatccctatcagcggcaccgtgaactacgcccagaaattccagggcagagtgacaatcaccgccgacgagagcacaagcaccgcctacatggaactgtccagcctgagaagcgaggacaccgccgtgtactactgtgccagacctctggattggaccgaggacatctggggccagggaacactggtcacagtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2176 - DNA, 3414 bp, Artificial Sequence
  Synthetic Polynucleotide encoding a CAR with optional accessory module(s)
atggccttaccagtgaccgccttgctcctgccgctggccttgctgctccacgccgccaggccgaacttcatgctgacccagcctcacagcgtgtccgagtctccaggcaagaccgtgaccatcagctgtacaggcagcagcggctctatcgccagcaactacgtgcagtggtatcagcagaggccaggcagcgcccctaccatcctgatctacgaggataacaagcggcctagcggcgtgcccgatagattttctggcagcatcgacagcagcagcaacagcgccagcctgacaatcagcggcctgaaaacaggcgacgaggccgactactactgccagagctacgacgacatcaaccactgggttttcggcggaggcaccaagctgacagttcttggaggcggaggcggaagtggaggcggaggatctggcggcggaggctctgaagttcagctggttcagagcggagccgaagtgaagaaacctggggcctctgtgaaggtgtcctgcaaggcttccggctacacctttaccgcctactacctgcactggctgagacaggctccaggccaaggactggaatggatgggctggatgaacaccaacaacggggccaccagatacgcccagaaattccaggacagagtgaccatgaccagagacaccagcatcaacaccgcctacatggaaatgagcggcctgtcctccgacgacaccgccatgtactattgtgccagaggcgacatcagccaggacttcgctgatgtgtggggccagggaacactggtcacagtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2177 - DNA, 3390 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgacacagagccctgccatcatgtccgcttctcccggcgagaaagtgaccatcacatgtagcgccagcagcagcgtgtcctacatgcactggttccagcagaagcccggcacaagccctaagctgtggatctacagcaccagcaatctggcctctggcgtgccagccagattttctggctctggcagcggcaccagctacagcctgacaatcagcagaatggaagccgaggacgccgccacctactactgtcagcagagaagcagctaccctcctacctttggcggaggcaccaagctggaaatcaaaggcggaggcggaagtggaggcggaggatctggcggcggaggctctcaggttcagctccagcagagcggagccgagcttatgaagcctggcgcttccgtgaagatcagctgcaaggccaccggctacaccttcagcagctactggatcgagtgggtcaagcagaggcccggacatggcctggaatggatcggagagatcctgcctggaagcggcagcaccaactacaacgagaagttcaagggcaaagccaccttcaccgccgacaccagcagcaacacagcctatatgcagctgagcagcctgaccagcgaggacagcgccgtgtactactgcgccagatacgactacccttggtttgcctattggggccagggcaccctggttacagtttctgctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2178 - DNA, 3414 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacacagagccctagcagcctgacagtgacagccggcgagaaagtgaccatgagctgcaagagcagccagagcctgctgaacagcggcaaccagaagaactacctgacctggtatcagcagaagcccggccagcctcctaagctgctgatctactgggccagcaccagagaaagcggcgtgcccgatagattcacaggcagcggcagcggaaccgacttcaccctgacaatcagctctgtgcaggccgaggatctggccgtgtactactgccagaacgactacagctaccccttcacctttggctccggcaccaagctggaaatcaaaggcggaggcggaagtggaggcggaggatctggcggcggaggctctcaagttcagctgcaacagcctggggccgaactcgttagacctggcgcttctgtgaagctgtcctgcaaggccagcggctacacctttaccagctactggatcaactgggtcaagcagcggcctggacagggcctcgaatggatcggcaatatctaccccagcgacagctacaccaactacaatcagaagttcaaggacaaggccacactgaccgtggacaagtctagcagcaccgcctacatgcagctgagcagccctacaagcgaggacagcgccgtgtattattgcacccggtcttggcggggcaacagcttcgattattggggccagggcacaaccctgaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2179 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaaggcggaggcggaagtggaggcggaggatctggcggcggaggctctcaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2180 - DNA, 3423 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacacagagccctagcagcctggctatgagcgtgggccagaaagtgaccatgacctgcaagagcagccagagcctgctgaacagcagcaaccagaagaactacctggcctggtatcagcagaagcccggacagtctcctaagctgctggtgtactttgccagcaccagagaaagcggcgtgcccgacagattcatcggctctggaagcggcaccgacttcaccctgacaatcagctctgtgcaggccgaggacctggccgattacttctgtcaccagcactacagcacccctctgacctttggagccggcaccaagctggaactgaaaggcggaggcggaagtggaggcggaggatctggcggcggaggctctgaagttcagctccagcagagcggccctgaccttgtgaaacctggcgcttccgtgaagatgagctgcaaggccagcggctacaccttcaccagctacgtgatgcactgggtcaagcagaaacccggccagggccttgagtggatcggctacatctacccctacaacgatggcaccaagtacaacgagaagttcaagggcaaagccacactgaccagcgacaagtctagcagcaccgcctacatggaactgagcagcctgacctctgaggacagcgccgtgtactactgcgccagagaggaatacggcaactacgtgcggtacttcgacgtgtggggagccggaacaaccgtgacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2181 - DNA, 3405 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggtcacacagcctccatccgtgtctgctgcccctggacagaaagtgaccatcagctgtagcggcagcagcagcaacatcggcaacaactacgtgtcctggtatcagcagctgcccggcacagctcccaaactgctgatctacgacaacaacaagcggcccagcggcatccccgatagattttctgccagcaagagcggcaccagcgccacactgggaatcacaggactccagaccagagatgaggccgactactactgcggcacctgggattcttctctgtccgcctgggttttcggcggaggcacaaaactgacagtgctcggaggcggaggcggaagtggaggcggaggatctggcggcggaggctctcaagttcagctggttcagtctggggccgaagtgaagaaacctggcagcagcgtgaaggtgtcctgcaaggcttccggcgataccttcagcagctactacatcagctgggtccgacaggccccaggacaaggacttgagtggatgggcagaatcatccccatcctgggaatcgccaactacgcccagaaataccagggcagagtgaccctgagcgccgacaagagcacaagcaccagctacatggaactgaacagcctgagcagcgaggacaccgccgtgtactattgtgccctggactggtcctacagcatcgactattggggccagggcaccctggtcacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2182 - DNA, 3423 bp, Artificial Sequence
  Synthetic Polynucleotide encoding a CAR with optional accessory module(s)
atggccttaccagtgaccgccttgctcctgccgctggccttgctgctccacgccgccaggccggaattcgaagtgaagctggtggaatctggcggcggactggttaagtttggcggcagcctgaagctgagctgtgccgcctctggctttaccctgagcagctactacatgagctgggtccgacagagccccgagaagagactggaactggtggccgtgattaacagcaacggcggcagcacctactatcccgacacagtgaagggcagattcaccatcagccgggacaacgccaagaacaccctgtacctccagatgtctagcctgaagtccgaggacacagccctgtactactgcgccagaccattctactacagcaacagccccttcgcctattggggccagggaacactggttacagtgtctgctggcggaggcggaagtggaggcggaggatctggcggcggaggctctgatgttctgatgacccagacacctctgagcctgcctgtgtctctgggcgatcaggccagcatctcctgtagaagcagccagagcatcgtgcacagaaccggcaacacctacctggaatggtatctccagaagcctgggcagagccccaagctgctgatctacaaggtgtccaacagattcagcggcgtgcccgacagattttctggcagcggctctggcaccgacttcaccctgaagattagcagagtgggagccgaggacctgggcgtctactactgctttcaaggcagccacgtgccatacacctttggcggaggcaccaagctggaaatcaagacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2183 - DNA, 3414 bp, Artificial Sequence
  Synthetic Polynucleotide encoding a CAR with optional accessory module(s)
atggccttaccagtgaccgccttgctcctgccgctggccttgctgctccacgccgccaggccggagctggtcatgacacagagccctgcttctctggccgtgtcactgggacagagagccaccatctcttgcagagccagcgagagcgtggacagctacggcaagagcttcatgcactggtatcagctcaagcccggccagcctcctaagctgctgatctacagagcctccaacctggaaagcggcgtgccagccagattttctggcagcggcagcagaaccgacttcaccctgaccattgatcccgtggaagccgatgatgccgccacctactactgccagcagaacaacgaggacccctggacatttggcggaggcaccaagctggaaatcaaaggcggaggcggaagtggaggcggaggatctggcggcggaggctctgaagtgcagctcgaacagtctggccccgagcttgtgaaacctggcgcttccgtgaagatgagctgcaaggccagcggctacaccttcaccaactactacatgaaatgggtcaagcagagccacggcaagtccctggaatggatcggcgatctgaaccccaacaacggcgacaccttctacaaccagaagttcaagggcaaagccacactgaccgtggacaagagcagcaacaccgcctacatgcagctcaactccctgaccagcgaggacagcgccgtgtactactgtgccagaaccggcagatacgaagagaacgctatggactactggggccagggcacaagcgtgacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2184 - DNA, 3396 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2185 - DNA, 3417 bp, Artificial Sequence
  Synthetic Polynucleotide encoding a CAR with optional accessory module(s)
atggccttaccagtgaccgccttgctcctgccgctggccttgctgctccacgccgccaggccggacgtgctgatgacccagacacctgtgtctctgtccgtgtctctgggagatcaggccagcatctcctgtagaagcagccagagcatcgtgcacagcaccggcaacacctacctggaatggtatctccagaagcctggacagagccccaagctgctgatctacaagatcagcaacagattcagcggcgtgcccgacagattttctggcagcggctctggcaccgacttcaccctgaagattagcagagtggaagccgaggacctgggcgtgtactactgcttccaagcctctcacgcccctagaacctttggcggaggcaccaagctggaaatcaagagaggcggaggcggaagtggaggcggaggatctggcggcggaggctctgaagtgatcctggtggaaagcggaggcggccttgtgaaacctggcggatctctgaagctgagctgtgccgccagcggcttcacctttagcagctacacaatgagctgggtccgacagacccctgagaagagactggaatgggtcgccaccatctcttccggcggagggaacacctactatcccgactctgtgaagggcagattcaccatcagccgggacaacgccaagaacaacctgtacctccagatgagcagcctgcggagcgaagatacagccctgtactattgcgcccggtactacagatacgaggcttggtttgcctcttggggccagggcacactggttacagtttctgctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2186 - DNA, 3027 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggaggactggtgcaggctggaagaagcctgagactgtcttgtgccgccagcgagcacacctttagctctcacgtgatgggctggttcagacaggcccctggcaaagaaagggaaagcgtggccgttatcggctggcgggatattagcaccagctacgccgatagcgtgaagggcagattcaccatcagccgggacaacgccaagaaaaccctgtacctccagatgaacagcctgaagccagaggacaccgccgtgtactactgcgccgccagaagaattgacgccgccgactttgattcttggggccagggaacccaagtgaccgtttctagcgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2187 - DNA, 3024 bp, Artificial Sequence
  Synthetic Polynucleotide encoding a CAR with optional accessory module(s)
atggccttaccagtgaccgccttgctcctgccgctggccttgctgctccacgccgccaggccggaagtgcaactggttgaatccggtggcggcctggtgcaagcaggcggatctctcagacttagctgtgccgcctccggcagaaccttcacaatgggatggtttaggcaggctccagggaaagagagagagttcgtcgccgccatctctctgtctcccacactggcctactacgccgagtctgtgaaaggccggttcaccatctccagagataatgccaagaacaccgtggtgctgcaaatgaactctctgaaacccgaggatacagccctgtactattgtgccgctgaccggaagtccgtgatgagcatcagacccgattactggggacagggcacacaagtcacagtgtcctctgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2188 - DNA, 3426 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggaggactggtgcaggctggaagaagcctgagactgtcttgtgccgccagcgagcacacctttagctctcacgtgatgggctggttcagacaggcccctggcaaagaaagggaaagcgtggccgttatcggctggcgggatattagcaccagctacgccgatagcgtgaagggcagattcaccatcagccgggacaacgccaagaaaaccctgtacctccagatgaacagcctgaagccagaggacaccgccgtgtactactgcgccgccagaagaattgacgccgccgactttgattcttggggccagggaacccaagtgaccgtttctagcggaggcggtggaagtggcggcggtggttcaggcggcggaggatctgaagtgcaactggttgaatccggtggcggcctggtgcaagcaggcggatctctcagacttagctgtgccgcctccggcagaaccttcacaatgggatggtttaggcaggctccagggaaagagagagagttcgtcgccgccatctctctgtctcccacactggcctactacgccgagtctgtgaaaggccggttcaccatctccagagataatgccaagaacaccgtggtgctgcaaatgaactctctgaaacccgaggatacagccctgtactattgtgccgctgaccggaagtccgtgatgagcatcagacccgattactggggacagggcacacaagtcacagtgtcctctgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2189 - DNA, 3018 bp, Artificial Sequence
  Synthetic Polynucleotide encoding a CAR with optional accessory module(s)
atggccttaccagtgaccgccttgctcctgccgctggccttgctgctccacgccgccaggccggaggtgcaactggttgagtctggcggaggactggttcaggcaggcggatctctgagactgagctgtatcgccaccggcaaggtgttcagcatctacgacatgggctggtacagacaggcccctggcaagcagagagagctggttgccgagatcacaagcagcggcaccacacactacgacgacttcgtgtccggcagattcaccatcagccgggacaacgccaagaacaccgtgtacctccagatgaacaccctgaaggccgaggacaccgccgtgtactactgtagagccaaccacgtgttcggcggcagctattggggacagggaacccaagtgacagtgtctagtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2190 - DNA, 3036 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagcttgttgaaagcggaggtggcctggttcaacctggcggaagcctgagactgtcctgtgaagccagcggctttaccctggactactacgccatcggctggtttagacaagctcccggcaaagagagagagggcgtcatctgcatcagcagatccgacggcagcacctactatgccgacagcgtgaagggacgcttcaccatctccagagacaatgccaaaaagacggtctacctgcaaatgatctccctcaagcctgaggataccgccgcctactattgtgccgctggcgctgattgcagcggctacctgagagactacgagttcagaggccagggcacacaagtgaccgtcagctctgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2191 - DNA, 3405 bp, Artificial Sequence
  Synthetic Polynucleotide encoding a CAR with optional accessory module(s)
atggccttaccagtgaccgccttgctcctgccgctggccttgctgctccacgccgccaggccggaggtgcaactggttgagtctggcggaggactggttcaggcaggcggatctctgagactgagctgtatcgccaccggcaaggtgttcagcatctacgacatgggctggtacagacaggcccctggcaagcagagagagctggttgccgagatcacaagcagcggcaccacacactacgacgacttcgtgtccggcagattcaccatcagccgggacaacgccaagaacaccgtgtacctccagatgaacaccctgaaggccgaggacaccgccgtgtactactgtagagccaaccacgtgttcggcggcagctattggggacagggaacccaagtgacagtgtctagtgaggtggccgctttggagaaacaggtgcagcttgttgaaagcggaggtggcctggttcaacctggcggaagcctgagactgtcctgtgaagccagcggctttaccctggactactacgccatcggctggtttagacaagctcccggcaaagagagagagggcgtcatctgcatcagcagatccgacggcagcacctactatgccgacagcgtgaagggacgcttcaccatctccagagacaatgccaaaaagacggtctacctgcaaatgatctccctcaagcctgaggataccgccgcctactattgtgccgctggcgctgattgcagcggctacctgagagactacgagttcagaggccagggcacacaagtgaccgtcagctctgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2192 - DNA, 3054 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggcagactggtgcagcctagaggaagcctgagactgtcttgtgccggcagcggcagaacctttagcacatacggcatggcctggttcagacaggcccctggaaaagagagagagttcgtcgccagcaaggccagcatgaactactccggcaggacctactacgccgacagcgtgaagggcagattcacaatcgccagagacaacgccaagaacatggtgttcctccagatgaacaatctgaagcccgaggacaccgccgtgtactattgtgccgctggcacaggctgtagcacctacggctgtttcgacgcccagatcatcgactactggggcaagggcacactggtcacagtttctagcgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2193 - DNA, 3027 bp, Artificial Sequence
  Synthetic Polynucleotide encoding a CAR with optional accessory module(s)
atggccttaccagtgaccgccttgctcctgccgctggccttgctgctccacgccgccaggccgcaagtcaaactggaagaaagcggtggcggcctggtgcaacctggcgaatctctgagactgagctgtagcgccagcggctccatcttcaaggtgttcagagtgttcgccatgagctggtacaggcaaggccctggcaagcagagagagctggtcgcctctatcagcagcggcgagacaaccacatacgccgactctgtgaaaggccggttcaccatcagccgggataatgccaagaataccgcctatctccagatggactccctgaagcctgaagatacagctgtgtactactgcaacgccgaccataccttcaccggcgatttttggggccagggaacccaagtgaccgtgtctagtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2194 - DNA, 3432 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggcagactggtgcagcctagaggaagcctgagactgtcttgtgccggcagcggcagaacctttagcacatacggcatggcctggttcagacaggcccctggaaaagagagagagttcgtcgccagcaaggccagcatgaactactccggcaggacctactacgccgacagcgtgaagggcagattcacaatcgccagagacaacgccaagaacatggtgttcctccagatgaacaatctgaagcccgaggacaccgccgtgtactattgtgccgctggcacaggctgtagcacctacggctgtttcgacgcccagatcatcgactactggggcaagggcacactggtcacagtttctagcgaggtggccgctttggagaaacaagtcaaactggaagaaagcggtggcggcctggtgcaacctggcgaatctctgagactgagctgtagcgccagcggctccatcttcaaggtgttcagagtgttcgccatgagctggtacaggcaaggccctggcaagcagagagagctggtcgcctctatcagcagcggcgagacaaccacatacgccgactctgtgaaaggccggttcaccatcagccgggataatgccaagaataccgcctatctccagatggactccctgaagcctgaagatacagctgtgtactactgcaacgccgaccataccttcaccggcgatttttggggccagggaacccaagtgaccgtgtctagtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2195 - DNA, 3021 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggagagctggttcaacctggcggacctctgagactgtcttgtgccgccagcggcaacatcttcagcatcaaccggatgggctggtacagacaggcccctggaaaacagagagccttcgtcgcctctatcaccgtgcggggcatcaccaattacgccgactctgtgaagggcagattcaccatcagcgtggacaagagcaagaacaccatctacctccagatgaacgccctgaagcctgaggacaccgccgtgtactactgcaatgccgtgtccagcaacagggaccccgattattggggccagggcacccaagtgacagtgtctagtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2196 - DNA, 3057 bp, Artificial Sequence
  Synthetic Polynucleotide encoding a CAR with optional accessory module(s)
atggccttaccagtgaccgccttgctcctgccgctggccttgctgctccacgccgccaggccgcctgttcaactggttgaatctggcggcggactggtgcaggctggcgatagtctcagactgagctgtgccgcctccggcagaacatttggcatcggcacaatgggatggttccggcagcctcctggaaaagaacgcgaatttgtggccgccatcagatggtctacaggcggcaccagatacgccgacagcgtgaaaggccggtttaccatcagcagagacaacgccaagctgaccgtggatctccagatggatagcctgaaaccagaggatacagccgtctattactgcgccgctgacaggctgagcctggatctgtctggcagataccactacaaccctgccgtgtacgactactggggacagggaacacaagtcaccgtgtcctctgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2197 - DNA, 3453 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggagagctggttcaacctggcggacctctgagactgtcttgtgccgccagcggcaacatcttcagcatcaaccggatgggctggtacagacaggcccctggaaaacagagagccttcgtcgcctctatcaccgtgcggggcatcaccaattacgccgactctgtgaagggcagattcaccatcagcgtggacaagagcaagaacaccatctacctccagatgaacgccctgaagcctgaggacaccgccgtgtactactgcaatgccgtgtccagcaacagggaccccgattattggggccagggcacccaagtgacagtgtctagtggaggcggtggaagtggcggcggtggttcaggcggcggaggatctcctgttcaactggttgaatctggcggcggactggtgcaggctggcgatagtctcagactgagctgtgccgcctccggcagaacatttggcatcggcacaatgggatggttccggcagcctcctggaaaagaacgcgaatttgtggccgccatcagatggtctacaggcggcaccagatacgccgacagcgtgaaaggccggtttaccatcagcagagacaacgccaagctgaccgtggatctccagatggatagcctgaaaccagaggatacagccgtctattactgcgccgctgacaggctgagcctggatctgtctggcagataccactacaaccctgccgtgtacgactactggggacagggaacacaagtcaccgtgtcctctgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2198 - DNA, 3027 bp, Artificial Sequence
  Synthetic Polynucleotide encoding a CAR with optional accessory module(s)
atggccttaccagtgaccgccttgctcctgccgctggccttgctgctccacgccgccaggccggccgtgcaactggttgaatctggcggaggactggtgcaggctggcgattctctgagactgacctgtacagccagcggcagagccttcagcacctacttcatggcctggttcagacaggcccctggcaaagagagagagttcgtcgccggaatcgcttggagcggaggctctacagcctacgccgattctgtgaagggcagattcaccatcagccgggacaacgccaagaacaccgtgtacctccagatgaacagcctgaagtccgaggacaccgccgtgtactactgtgccagcagaggcatcgaggtggaagagtttggagcctggggccagggaacccaagtgacagtttcttctgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2199 - DNA, 3030 bp, Artificial Sequence
  Synthetic Polynucleotide encoding a CAR with optional accessory module(s)
atggccttaccagtgaccgccttgctcctgccgctggccttgctgctccacgccgccaggccgcaggttcaactggtggaaagtggcggtggcttggtgcaagcaggcggctctcttagactgtcttgtgctgcctctggcggcaccctgagcaagaataccgtggcatggtttaggcaggctcccggaaaagagcggggctttgtcgccagcatcacctgggatggcagaaccacctactacgccgacagcgtgaaaggccggttcaccatctccagagataatgccaagaatacggtctacttgcaaatgaactccctgaagcctgaagatacagccgtgtacgtgtgcgccgatctcggcaaatggcctgctggacctgccgattattggggacagggcacacaagtcaccgtgtcctctgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2200 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccggccgtgcaactggttgaatctggcggaggactggtgcaggctggcgattctctgagactgacctgtacagccagcggcagagccttcagcacctacttcatggcctggttcagacaggcccctggcaaagagagagagttcgtcgccggaatcgcttggagcggaggctctacagcctacgccgattctgtgaagggcagattcaccatcagccgggacaacgccaagaacaccgtgtacctccagatgaacagcctgaagtccgaggacaccgccgtgtactactgtgccagcagaggcatcgaggtggaagagtttggagcctggggccagggaacccaagtgacagtttcttctcctggcggaggcgggtctcctcaggttcaactggtggaaagtggcggtggcttggtgcaagcaggcggctctcttagactgtcttgtgctgcctctggcggcaccctgagcaagaataccgtggcatggtttaggcaggctcccggaaaagagcggggctttgtcgccagcatcacctgggatggcagaaccacctactacgccgacagcgtgaaaggccggttcaccatctccagagataatgccaagaatacggtctacttgcaaatgaactccctgaagcctgaagatacagccgtgtacgtgtgcgccgatctcggcaaatggcctgctggacctgccgattattggggacagggcacacaagtcaccgtgtcctctgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2201 - DNA, 3492 bp, Artificial Sequence
  Synthetic Polynucleotide encoding a CAR with optional accessory module(s)
atggccttaccagtgaccgccttgctcctgccgctggccttgctgctccacgccgccaggccggccgtgcaactggttgaatctggcggaggactggtgcaggctggcgattctctgagactgacctgtacagccagcggcagagccttcagcacctacttcatggcctggttcagacaggcccctggcaaagagagagagttcgtcgccggaatcgcttggagcggaggctctacagcctacgccgattctgtgaagggcagattcaccatcagccgggacaacgccaagaacaccgtgtacctccagatgaacagcctgaagtccgaggacaccgccgtgtactactgtgccagcagaggcatcgaggtggaagagtttggagcctggggccagggaacccaagtgacagtttcttctcctggcggaggcgggtctcctcaggttcaactggtggaaagtggcggtggcttggtgcaagcaggcggctctcttagactgtcttgtgctgcctctggcggcaccctgagcaagaataccgtggcatggtttaggcaggctcccggaaaagagcggggctttgtcgccagcatcacctgggatggcagaaccacctactacgccgacagcgtgaaaggccggttcaccatctccagagataatgccaagaatacggtctacttgcaaatgaactccctgaagcctgaagatacagccgtgtacgtgtgcgccgatctcggcaaatggcctgctggacctgccgattattggggacagggcacacaagtcaccgtgtcctctgaggttgccgcactggagaaggaagtagccgcgcttgagaaagaggtggcagcgctggagaaagaagttgccgccttggaaaaagacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2202 - DNA, 3414 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagcgccagcagcagcgtgtcctacatgtactggtatcagcagaagcccggacaggcccctagactgctgatctacagaaccagcaacctggcctctggcatccccgccagattttctggctctggcagcggcaccgatttcaccctgaccataagcagcctggaacctgaggacttcgccgtgtactactgccagcagtaccacagctaccccaccacctttggacagggcaccaaggtggaaatcaagcggacagttggcggaggcggaagtggaggcggaggatctggcggcggaggctctgaagtgcagctggttgaatcaggtggcggcctggttcaacctggcggatctctgagactgtcttgtgccgccagcggcttcagcttcaacacctacgccatgaactgggtccgacaggctcctggcaaaggactggaatgggtgtcccacatcagaagcaagagcaacaacttcgccacctactacgccgacagcgtgaaggacagattcaccatcagccgggacaacgccaagaacagcctgtacctccagatgaactccctgagagccgaggacaccgccgtgtattattgcgccagacaaggcggcgacttccctatggattattggggccagggcaccctggtcaccgtttcttctacgcgtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2203 - DNA, 3396 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaaggcggaggcggaagtggaggcggaggatctggcggcggaggctctcaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2204 - DNA, 3411 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagaggcggaggcggaagtggaggcggaggatctggcggcggaggctctgaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2205 - DNA, 3405 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagaggcggaggcggaagtggaggcggaggatctggcggcggaggctctgaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2206 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcacgcgtattcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2207 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactacaacagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2208 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactaccaaagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2209 - DNA, 3300 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2210 - DNA, 3321 bp, Artificial Sequence
  Synthetic Polynucleotide encoding a CAR with optional accessory module(s)
atggccctgcctgtgacagctctgctgctgcctctggcactgctgctgcacgccgccagacctgacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaagggaggcggaggaagtggcggcggaggatctgggggaggcggaagccaggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2211 - DNA, 3318 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccaggccgctcccagcatccctgtgacacctggcgagagcgtgtccatctcctgccggtctagcaagagcctgctgaacagcaacggcaatacctacctgtactggttcctccagcggccaggccagtctccccaactgctgatctaccggatgagcaacctggcctccggcgtgcccgatagattttctggcagcggctccggcaccgccttcaccctgagaatcagcagagtggaagccgaggacgtgggcgtgtactactgtatgcagcacctggaataccccttcaccttcggagccggcaccaagctggaactgaagagaggcggaggcggaagtggaggcggaggatctggcggcggaggctctgaagtgcaactccagcagagcggccctgagctgattaagcctggggccagcgtgaagatgagctgcaaggccagcggctacaccttcaccagctacgtgatgcactgggtcaagcagaagcccggccagggcctggaatggatcggctacatcaacccctacaacgatggcaccaagtacaacgagaagttcaagggcaaggccaccctgaccagcgacaagagcagcagcaccgcctacatggaactgagcagcctgacaagcgaggacagcgccgtgtactattgcgccagaggcacctactactacggcagccgggtgttcgactattggggccagggcaccacactgaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2212 - DNA, 3312 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccccgatttccagagcgtgacccctaaagaaaaagtgaccatcacctgtcgggccagcgagagcgtggacacattcggcatcagcttcatgaactggttccagcagaagcccgatcagagccccaagctgctgattcacgccgccagcaatcaaggcagcggagtgcctagcagattttccggctctggcagcggcaccgatttcaccctgaccatcaatagcctggaagccgaggatgccgccacctactactgccagcagagcaaagaggtgcccttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcagctcttggatgaactgggtccgacaggcccctggcaaaggactggaatgggtcggaagaatctaccccggcgacggcgacaccaactacaacggcaagttcaagggcagattcaccatcagccgggacgacagcaagaacagcctgtacctgcagatgaactccctgaaaaccgaggacaccgccgtgtactactgtgccagatccggcttcatcaccaccgtgctggacttcgattattggggccagggcaccctggtcaccgtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2213 - DNA, 3300 bp, Artificial Sequence
  Synthetic Polynucleotide encoding a CAR with optional accessory module(s)
atggccttaccagtgaccgccttgctcctgccgctggccttgctgctccacgccgccaggccggccattcagctcacacagagcccttctagcctgagcgcctctgtgggcgacagagtgaccatcacatgtagagccagccagggcatcagcagcgcccagcagaaacctggaaaggcccctaagctgctgatcctggcctggtacagcagcctggaaagcggagtgcctagcagattcagcggctacgatgcctctggcagcggcaccgatttcaccctgacaatatccagcctccagcctgaggacttcgccacctactactgccagcagttcaacagctacccctacaccttcggccagggcaccaagctggaaatcaaaggcggaggcggaagtggaggcggaggatctggcggcggaggctctgaagtgcaactggttcagagcggagccgaagtgaagaagcctggcgagagcctgaagattagctgcaaaggctccggctacagcttcagcagctcttggatcggctgggtccgacagatgcctggcaaaggactggaatggatgggcatcatctaccccgacgacagcgacaccagatacagccctagcttccagggccaagtgacaatcagcgccgacaagagcatcagaaccgcctacctccagtggtcctctctgaaggccagcgataccgccatgtactactgcgccagacacgtgaccatgatctggggagtgattatcgacttctggggccagggaaccctggtcacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2214 - DNA, 3372 bp, Artificial Sequence
  Synthetic Polynucleotide encoding a CAR with optional accessory module(s)
atggccttaccagtgaccgccttgctcctgccgctggccttgctgctccacgccgccaggccgatcaacatctacaacgccgagcctgccaatcctagcgagaagaacagccccgaattcgacatcgtgatgacacagagccccgccacactgtcactgtctccaggcgaaagagccacactgagctgtcggagcagcaagagcctccagaacgtgaacggcaacacctacctgtactggttccagcagaagcccggccagtctcctcagctcctgatctacagaatgagcaacctgaacagcggcgtgcccgacagattttctggcagcggaagcggcaccgagttcaccctgaccataagcagcctggaacctgaggacttcgccgtgtactactgtatgcagcacctggaataccccatcaccttcggagccggcaccaagctggaaatcaaaggcggaggcggaagtggaggcggaggatctggcggcggaggctctgaagtgcaactggttgaatctggcggcggactggttaagcctggcggatctctgaagctgagctgtgccgccagcggctacacctttaccagctacgtgatgcactgggtccgacaggcccctggcaaaggacttgagtggatcggctacatcaacccctacaacgatggcaccaagtacaacgagaagttccagggcagagtgaccatcagctccgacaagagcatcagcaccgcctacatggaactgagcagcctgagaagcgaggataccgccatgtactattgcgccagaggcacctactactacggcaccagagtgttcgactactggggccagggaaccctggtcacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2215 - DNA, 3318 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacacagtctcccgccacactgtcactgtctccaggcgaaagagccacactgagctgtagagccagccagagcgtggactacgacggcgacagctacctgaactggtatcagcagaagcccggccagcctcctaagctgctgatctacgatgccagcaacctggtgtctggcatccctcctagattttccggcagcggctctggcaccgatttcaccctgaccatcagcagactggaacccgaggacttcgccgtgtaccactgtcagcagagcacagaggacccctggacatttggcggaggcaccaagctggaaatcaaaggcggaggcggaagtggaggcggaggatctggcggcggaggctctcaggtgcagctggttgaatctggcggcggacttgttgagcctggcggatctctgagactgagctgcatgagcggctacgccttcagcagctactggatgaactgggtccgacagatgcccggcaaaggactggaatggatgggccagatttggcctggcgacggcgataccaactacaaccccagcctgaagtccagagtgaccatcaccgccgatgagagcaccagcaccgcctacatggaactgtctagcctgaaggccgaggatacagccgtgtacttctgcgccagacgggaaaccacaaccgtgggcagatattactacgctatggactactggggccagggcaccctggttacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2216 - DNA, 3309 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacacagtctcccgccacactgtcactgtctccaggcgaaagagccacactgagctgtagagccagccagagcgtggacaactacggcatcagcttcatgaactggtatcagcagaagcccggccagcctcctaagctgctgatctacgccgccagcaatcaaggctctggcatccccagcagattttccggctctggaagcggcaccgacttcaccctgaccataagcagcctggaacctgaggacttcgccatgtacttttgccagcagagcaacgaggtgcccagaacctttggcggaggcaccaagctggaaatcaaaggcggaggcggaagtggaggcggaggatctggcggcggaggctctcaggtgcaactggttgagtctggcggcggacttgttgaacctggcggaagcctgagactgagctgcatgagcggctacgcctttagcagctcctggatgaactgggtccgacagatgcctggcaaaggactggaatggatgggcagaatctaccccggcgacggcgacaccaactacaacggcaagttcaaagaacgggtcaccatcaccgccgacgagagcacaagcaccgcctacatggaactgagcagcctgaaggccgaggataccgccgtgtacttctgcgccagaagcgagtattggggcaactactgggctatggactactggggccagggcacactggtcacagtgtctagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2217 - DNA, 3306 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacacagtctcccgccacactgtcactgtctccaggcgaaagagccacactgagctgcaaggccagtcagaacgtgggcacaaacgtggcctggtatcagcagaagcctggacagcctcctaagctgctgatctacagcgccacctaccggaactctggcatccctgccagattttctggcagcggctctggcaccgagttcaccctgaccatcaccaacgtgcagagcaaggacctggccgactacttctacttctgccagtacaacagatacccctacaccagcggcggaggcaccaagctggaaatcaaaagaggcggaggcggaagtggaggcggaggatctggcggcggaggctctcaggtgcaactggttgaatcaggcggaggactggtggaacctggcggatctctgagactgagctgtatgagcggctacgccttcagcagctactggatgaactgggtccgacagatgcccggcaaaggactggaatggatgggccaaatctaccccggcgacggcgacaccaactacaacggcaagttcaagggcagagtgacaatcaccgccgacgagagcacaagcaccgcctacatggaactgagcagcctgaaggccgaggataccgccgtgtacttctgcgccagaaagaccatcagcagcgtggtggatttctacttcgacaactggggccagggcaccctggtcacagtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2218 - DNA, 3345 bp, Artificial Sequence
  Synthetic Polynucleotide encoding a CAR with optional accessory module(s)
atggccttaccagtgaccgccttgctcctgccgctggccttgctgctccacgccgccaggccgatcaacatctacaacgccgagcctgccaatcctagcgagaagaacagccccgaattccagatcgtgctgacacagtctccagccacactgagcgcttctccaggcgagaaggccaccatgacatgttctgccagcagcggcgtgaactacatgcactggtatcagcagaagcccggcacaagccccaagcggtggatctacgataccgacaagacagccagcggagtgcccgccagattttctggctctggcagcggcacatcctacagcctgacaatcagcagcatggaagccgaggatgccgccacctactactgtcaccagagaggcagctacaccttcggcggaggcaccaagctggaaatcaaaggcggaggcggaagtggaggcggaggatctggcggcggaggctctcaagttcagctggaacaacctggcgctgaggtggtcaaaccaggggcctctgtgaaggtgtcctgcaagacaagcggctacacattcaccagcaactggatgcactgggtcaagcagacccctggcaaaggactggaatggatcggcgagatcgaccccagcgactcctacaccaactacaaccagaagttcgacggcaaggccaagctgaccgtggacaagtctagcagcaccgcctacatggaagtgtccgatctgaccgccgaagatagcgccacatattactgcgccagaggcagcaacccctactactacgctatggactattggggccagggcaccagcgtgacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2219 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2220 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggacgacatccagctgacccagagccccagcagcctgagcgccagcgtgggcgacagagtgaccatcacctgcaaggccagccagagcgtggactacgacggcgacagctacctgaactggtaccagcagatccccggcaaggcccccaagctgctgatctacgacgccagcaacctggtgagcggcatcccccccagattcagcggcagcggcagcggcaccgactacaccttcaccatcagcagcctgcagcccgaggacatcgccacctaccactgccagcagagcaccgaggacccctggaccttcggcggcggcaccaagctgcagatcaagagaggcggaggcggaagtggaggcggaggatctggcggcggaggctctcaggtgcagctgcagcagagcggcgccgaggtgaagaagcccggcagcagcgtgaaggtgagctgcaaggccagcggctacgccttcagcagctactggatgaactgggtgagacagagacccggccagggcctggagtggatcggccagatttggcccggcgacggcgacaccaactacaacggcaagttcaagggcagagccaccatcaccgccgacgagagcaccaacaccgcctacatggagctgagcagcctgagaagcgaggacaccgccttctacagctgcgccagaagagagaccaccaccgtgggcagatactactacgctatggactactggggccagggcaccaccgtgaccgtgagcagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2221 - DNA, 3300 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctgcctctgtgtctggctctcctggccagagcatcaccatcagctgtaccggcaccagctctgatgtcggcggctacaattacgtgtcctggtatcagcagcaccccggcaaggcccctaagctgatgatctacgacgtgaacaacagacccagcgaggtgtccaacagattcagcggcagcaagagcggcaataccgccagcctgacaatctctggactgcaagccgaggacgaggccgactactactgtagcagctacaccacaggcagcagagccgtttttggcggaggcaccaaactgacagtgcttggaggcggaggcggaagtggaggcggaggatctggcggcggaggctctgaagttcagctggttcagtctggcgccgaagtgaagaagcctggcgagtctctgaccatctcctgcaaggccagcggctacagcttccccaactactggatcacctgggtccgacagatgtccggtggtggccttgagtggatgggcagaatcgatcccggcgactcctacaccacctacaatcctagcttccagggccacgtgaccatcagcatcgacaagagcaccaacaccgcctacctgcactggaacagcctgaaagccagcgacaccgccatgtactactgcgcccggtactatgtgtccctggtggacatttggggccagggcacactggtcacagtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2222 - DNA, 3318 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggtcacacagcctccatccgtgtctgctgcccctggacagaaagtgaccatctcctgtagcggcagcagcagcaacatcggcaacaactacgtgtcctggtatcagcagctccccggcacagctcccaaactgctgatctacgacaacaacaagcggcccagcggcatccccgatagattttctggcagcaagagcggcaccagcgccacactgggaattaccggacttcagacaggcgacgaggccgactactactgtggcacatgggatggcagcctgtacaccatgcttttcggcggaggcaccaagctgacagtgcttggcggaggcggaagtggaggcggaggatctggcggcggaggctctgaagtgcaactggtggaatctggcggcggactggttaagcctggcggatctctgagactgtcttgtgccgccagcggcttcaccttcagcaatgcctggatgagctgggttcgacaggcccctggaaaaggactggaatgggtcggattcatccggtccaaagcctacggcggcaccacagaatatgccgcctctgtgaagggcagattcaccatcagccgggacgacagcaagtctatcgcctacctccagatgaacaacctgaaaaccgaggacaccgccgtgtactactgcgccagagatggcctgtacagcagctcttggtacgacagcgattactggggccagggcacactggtcacagtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2223 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctcctagtgtgtctggcgctcctggacagagagtgaccatctcttgtaccggcagcagcagcaatatcggagccggctatgacgtgcactggtatcagcagctccctggcacagcccctaaactgctgatcttcggcaacagcaacagacccagcggcgtgcccgatagattcagcggctttaagagcggcacaagcgccagcctggctatcactggactgcaagccgaggacgaggccgactacttctgccagagctacgatagcagcctgagcggcagcggagtgtttggcacaggcaccaaagtgacagtgcttggcggcggaggcggaagtggaggcggaggatctggcggcggaggctctcaaatgcaactggttcaaagcggcggtggcctggtgcaacctggaagaagtctgagactgagctgtgccgccagcggcttcaccttcgatgattacgccatgcactgggtccgacaggcccctggaaaaggactggaatgggtgtccggcatctcctggaatagcggctctatcggctacgccgacagcgtgaagggcagattcaccatcagccgggacaacgccaagaacagcctgtacctccagatgaactccctgagagccgaggatacagccctgtactactgcgccaaggacatccacagcggcagctactacggcctgctgtactacgctatggacgtgtggggccagggcacaaccgtgacagtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2224 - DNA, 3294 bp, Artificial Sequence
  Synthetic Polynucleotide encoding a CAR with optional accessory module(s)
atggccttaccagtgaccgccttgctcctgccgctggccttgctgctccacgccgccaggccggactacatccacgtgacacagagccctagcagcctgtccgtgtccatcggcgatagagtgaccatcaactgccagacctctcaaggcgtgggcagcgacctgcactggtatcagcacaaacctggcagagcccctaagctgctgatccaccatgccagctctgtggaagatggcgtgcccagcagattttccggcaccggatttcacaccagcttcaacctgacaatcaacgacctccaggccgacgacatcggcacctactactgtcaagtgctccagagcttcggcagaggcagcagactggatacaaaaggcggaggcggaagtggaggcggaggatctggcggcggaggctctagggcacacctggtgcagtctggcaccgccatgaagaaacctggcgcttccgtcagagtgtcctgtcagacaagcggctacaccttcacagcccacatcctgttctggttcagacaggccccaggcagaggactggaatgggtcggatggatcaagccccagtacggggccgtgaatttcggcggaggcttcagagacagagtgaccctgaccagggacgtgtaccgggaaatcgcctacatggacatccggggcctgaagcctgatgacaccgccgtgtactactgcgccagggatagaagctacggcgacagctcttgggctctcgatgcttggggacagggcacaacagtggtggtgtctgctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2225 - DNA, 3324 bp, Artificial Sequence
  Synthetic Polynucleotide encoding a CAR with optional accessory module(s)
atggccttaccagtgaccgccttgctcctgccgctggccttgctgctccacgccgccaggccggacgtgcagatgatccagacccccgatagcctggccgtgtccctgggacagagagccaccatctcttgcagagccagcgagagcgtggacaactacggcatcagcttcatgcactggtatcagcagaagcccggccagagccccaagctgctgatctacagagcctccaacctggaaagcggcatccccgccagattttccggcagcggcagcagaaccgacttcaccctgaccatcaaccccgtggaaaccgacgacgtggcaacctactactgccagcagaacaacaaggacccccccacctttggcggaggcaccaagctggaaatcaagggcggaggcggaagtggaggcggaggatctggcggcggaggctctgggggaggcggctctcaggtgcaactccagcagtctggcgctgagcttgtgaagcctggggccagcgtgaagattagctgcaaggccagcggctacgccttcagcagctactggatgaactgggtcaagcagcggcctggcaagggcctggaatggatcggccaaatctaccccggcgacggcgacaccacctacaacggcaagttcaagggcaaggccaccctgacagccgacaagagcagcagcaccgtgtacatgcaactgaacagcctgaccagcgaggacagcgccgtgtacttctgcgtgcggtactactacggcagctccggctacttcgactattggggccagggcaccacactgaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2226 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggacgtgcagatgatccagacccccagcagcctgtctgccagcctgggcgatagagtgaccatcagctgtcgggccagccaggacatcggcaactacctgaactggtatcagcagaaacccgacggcaccgtgaagctgctgatctactacaccagcagactgcacagcggcgtgcccagcagattttctggcagcggctctggcaccgagtacagcctgaccatctccaacctggaacaggaagatattgctacctacttctgtcagcaaggcagcgccctgccccctacatttggcggcggaacaaagctggaaatcaacggcggaggcggaagtggaggcggaggatctggcggcggaggctctgctctccagctccagcagtctggcgcagaactcgtgcggcctggcgcttctgtgaccctgagctgtaaagccagcggctacaccttcaccgactacgagatgcactgggtcaagcagacccctgtgcacggcctggaatggatcggagccatcgaccctgagacaggcggcaccgcctacaaccagaagttcgagggcaaggccatcctgaccgccgacaagagcagcagcacagcctacatggaactgcggagcctgacctccgaggacagccccgtgtactactgtgccagacggcggtactacggcagcagctccttcgactattggggccagggcaccaccctgaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2227 - DNA, 3318 bp, Artificial Sequence
  Synthetic Polynucleotide encoding a CAR with optional accessory module(s)
atgaggctccctgctcagctcctggggctgctaatgctctgggtctctggaagcagtggggatgttgtgatgactcagtctccactctccctgcccgtcacccctggagcgccggcctccatctcctgcagatccagtcagagcattgtacatagtaatggaaacacctatttagagtggtatcttcaaaagccagggcagtctccaaagctcctgatctataaagtttccaaccgattttctggagtccctgacaggttcagtggaagtggatcaggcacagattttacactgagaatcagcagagtggaggctgaggatgttggaatttattactgctttcaaggttcacatgttcctccgacgttcggccctgggaccaaattggaaatcaaaggcggaggcggaagtggaggcggaggatctggcggcggaggctctgaagtgcagctggtggagtctgggggaggcttggtccagcctggggggtccctgagactctcctgttcagcctctggattcacctttagtagctttggaatgcactgggtccgccaggctccagggaaggggctggaatgggtggcctacattagtagtggcagtagtaccatctactatggagacaccgtgaagggccgattcaccatctccagagacaacgccaagaactcactgtttctgcaaatgagcagcctgagagccgaggacacggccgtgtattattgtgcgagagaggggggatattactacggaaggagttactatactatggactactggggccaagggaccacggtcaccgtctccacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2228 - DNA, 3393 bp, Artificial Sequence
  Synthetic Polynucleotide encoding a CAR with optional accessory module(s)
atggccttaccagtgaccgccttgctcctgccgctggccttgctgctccacgccgccaggccggccagaaagagaacccagcccaccttcggcttcaccgtgaactggaagttcagcgagagcaccaccgtgttcaccggccagtgcttcatcgaccggaacggcaaagaggtgctgaaaaccatgtggctgctgcggagcagcgtgaacgacatcggcgacgactggaaggccaccagagtgggcatcaacatcttcacccggctgcggacacagaaagagggcggctctggcggaagcgccagaaagtgtagcctgaccggcaagtggaccaacgacctgggcagcaacatgaccatcggagccgtgaacagcagaggcgagtttaccggcacctacatcaccgccgtgaccgccaccagcaacgagatcaaagagagccccctgcacggcacccagaacaccatcaacaagagcggcggcagcacaacagtgtttacaggacagtgctttattgaccgcaatgggaaagaagtgctgaaaacaatgtggctgctgaggtcctccgtgaatgacattggagatgattggaaagctacaagagtggggattaacatttttaccagactgaggacccagaaagaagggggcagcggaggctccgccagaaaatgctctctgacagggaagtggacaaatgatctggggtccaatatgacaatcggcgctgtgaactctcggggcgagttcactggaacatatattacagccgtgacagctacctctaacgaaatcaaagagtctcctctgcacgggacacagaataccattaacaaacggacccagcctacatttgggtttacagtgaattggaaattctccgagacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2229 - DNA, 3309 bp, Artificial Sequence
  Synthetic Polynucleotide encoding a CAR with optional accessory module(s)
atggccttaccagtgaccgccttgctcctgccgctggccttgctgctccacgccgccaggccggacatcgtcctgacccagtccccagccagcctggcggtgtccctgggtcaacgagctaccatttcctgcagagcctctaagtccgtatccacttccggctatagttacctgcattggtaccaacagaaaccagggcagccacccaagctgctcatctatctggcctcaaacctggagtccggcgtgcccgccagattctccggaagtgggagcggcaccgactttacattgaacatccacccagtcgaagaggaagatgctgccacttattactgtcagcactccagggagctgccatttacatttggctctggcacaaaactggagatcaaaggcggaggcggaagtggaggcggaggatctggcggcggaggctctcaggttcagctggtcgagtccgggggaggtctggtacagccgggtggcagcctcaagctgtcatgtgccgcatctggttttgactttagcaggtattggatgagctgggtccgccaggccccgggcaagggacttgagtggattggagaaataaaccctacttccagcacaatcaacttcacaccttctttgaaagataaggtttttatctctcgggataacgctaaaaacacactgtacttgcagatgtctaaggtgcgaagcgaagacaccgccctctattattgcgcccggggtaattactaccgctatggggatgcgatggactattgggggcaaggtacctccgtcacggtctcaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2230 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccctagctcactgagcgccagcgtgggcgacagggtgaccattacctgctccgccagccaggacatcagcaactacctgaactggtaccagcagaagcccggcaaggcccccaagctgctgatctactacacctccaacctgcactccggcgtgcccagcaggttcagcggaagcggcagcggcaccgatttcaccctgaccatctccagcctgcagcccgaggacttcgccacctactactgccagcagtacaggaagctcccctggactttcggccagggcaccaaactggagatcaagcgtggcggaggcggaagtggaggcggaggatctggcggcggaggctctcaggtgcagctggtccagagcggcgccgaagtgaagaagcccggcagctccgtgaaagtgagctgcaaggccagcggcggcaccttcagcaactactggatgcactgggtgaggcaggcccccggacagggcctggagtggatgggcgccacctacaggggccacagcgacacctactacaaccagaagttcaagggccgggtgaccatcaccgccgacaagagcaccagcaccgcctacatggaactgagcagcctcaggagcgaggacaccgctgtgtattactgcgccaggggcgccatctacgacggctacgacgtgctggacaactggggccagggcacactggtgaccgtgtccagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2231 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctcaggtgcagctggtgcagtctggccccgaagtgaagaaacccggcgagtccgtgaagatcagctgcaaggccagcggctacaccttccggcactacagcatgaactgggtcaagcaggccccaggccagggcctgaagtggatgggcagaatcaacaccgagagcggcgtgcccatctacgccgacgacttcaagggccggttcagcttcaccgtggacaccagcgccagcaccgcctacctggaaatctccagcctgaccagcgaggataccgccgtgtatttctgctccaacgactacctgtacagcctggatttctggggccagggaaccaccctgacagtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2232 - DNA, 3306 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctcctagtgtgtctggcgctcctggacagagagtgaccatcagctgtacaggcagcagcagcaatatcggagccggctttgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctacgttttcggcaccggcaccaaagtgacagtgcttggtggcggaggcggaagtggaggcggaggatctggcggcggaggctctcaagttcagctggttcagagcggagccgaagtgaagaaacctggggcctctgtgaaggtgtcctgcaaggcttccggctacacctttaccgattactacatgcactgggtccgacaggctcccggccaaagacttgaatggatgggctggatcaaccccaacagcggcggcacaaattacgcccagaagttccaggaccggatcaccgtgaccagagacaccagctccaacaccggctacatggaactgacccggctgagatccgatgacaccgccgtgtactactgcgctagaagcccttactccggcgtgctggataagtggggacagggcacactggtcaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2233 - DNA, 3300 bp, Artificial Sequence
  Synthetic Polynucleotide encoding a CAR with optional accessory module(s)
atggccttaccagtgaccgccttgctcctgccgctggccttgctgctccacgccgccaggccgcaggctgttctgacacagcctccatctgcctctggcacacctggacagagagtgaccatctcctgtagcggcagcagcagcaacatcggcagctacaccgtgtcctggtatcagcagctccctggaacagcccctaagttcctgatctacagcaacaaccagcggcctagcggcgtgcccgatagattttctggcagcaagagcggcacaagcgccagcctggctatttctggactccagtctgaggacgaggccgactactattgtgccgcctgggacgatagcctgaacggctatgtgtttggcaccggcaccaaagtgacagtgcttggtggcggaggcggaagtggaggcggaggatctggcggcggaggctctgaagttcaactggttcagagcggagccgaagtgaagaagcctggcgagagcctgaagattagctgcaaaggcagcggctacgacttcaccacctactggatcggctgggtccgacagatgcctggcaaaggactggaatggatgggcatcatctaccccggcgacagcgacaccagatacagccctagcgttagaggccgcgtgaccatcagcgccgacaagtctatcaacaccgcctacctccagtggtccagcctggaagcctctgacaccgccatgtactactgcgccagaatgtggaccttcagccaggatggatggggccagggaacactggtcacagtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2234 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccgctgcctgttctgacacagcctccatctgcctctggcacacctggacagagagtgaccatcagctgtagcggcagaagcagcaacatcggcagcaacagcgtgaactggtacagacagcttcctggcgctgcccctaagctgctgatctacagcaacaaccagcggcctcctggcgtgccagtcagattttctggcagcaagagcggcacaagcgccagcctggctatttctggactccagtctgaggacgaggccacctactactgtgccacctgggacgacaacctgaacgtgcactacgtgttcggcaccggcaccaaagtgacagtgcttggaagtagaggcggaggcggaagtggaggcggaggatctggcggcggaggctctcttgaaatggctcaggtgcagctggtgcagagcggagccgaagtgaagaaacctggcagcagcgtgaaggtgtcctgcaaagcttctggcggcaccttcagcagctacgccatctcttgggttcgacaggcccctggacaaggactggaatggatgggcagaatcatccccatcctgggaatcgccaactacgcccagaaattccagggcagagtgacaatcaccgccgacaagagcaccagcaccgcctacatggaactgagcagcctgagaagcgaggacaccgccgtgtactattgtgcaagaggcggctactacagccacgacatgtggagcgaagattggggccagggcacactggtcacagtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2235 - DNA, 3300 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2236 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaggcggaggcggaagtggaggcggaggatctggcggcggaggctctcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2237 - DNA, 3306 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgcaagagcagccagagcatcctgtacagcagcaaccagaagaactacctggcctggtatcagcagaagcccggccagagccctaagctgctgatctactgggccagcaccagagaaagcggcgtgcccgatagattcagcggcagcggctctggcaccgacttcaccctgaccatcagttctcttcaggccgaggacgtggccgtgtactactgccaccagtacatcagctcctacaccttcggccagggcaccaagctggaaatcaagggcggaggcggaagtggaggcggaggatctggcggcggaggctctcaggtgcagctggtgcagtctggcgctgaagtgaagaaacctggggccagcgtgaaggtgtcctgcaaggccagcggctacacctttgccagccagtggatgcactggatgagacaggcccctggacagggcctggaatggatcggctggatcaaccccggcaacgtgaacaccaagtacaacgagaagttcaagggcagagccaccctgacagtggacaccagcaccaacaccgcctacatggaactgagcagcctgcggagcgaggacaccgccgtgtattattgcgccagaagcacctggtacagacccctggattattggggccagggaacccttgtgaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2238 - DNA, 3678 bp, Artificial Sequence
  Synthetic Polynucleotide encoding a CAR with optional accessory module(s)
atggttaggggcgttccattcagacatctgcttctggtcttgcagcttgcactcttgcccgctgccacccagggcaaaaaagtggtgctgggcaagaaaggcgacaccgtggaactgacctgcaccgccagccagaagaagtccatccagttccactggaagaacagcaaccagatcaagatcctgggcaaccagggcagcttcctgaccaagggacccagcaagctgaacgacagagccgacagcagacggtccctgtgggaccagggcaatttcccactgattatcaagaacctgaagatcgaggacagcgacacctacatctgcgaggtggaagatcagaaagaagaggtgcaactgctggtgttcggcctgaccgccaactccgacacccatctgctccagggccagagcctgaccctgacactggaaagccctccaggcagctcccccagcgtgcagtgtagaagcccacgaggcaagaacatccagggaggcaaaacattgtcagtgtcccaactggaactccaggactccggcacctggacctgtaccgtgctccagaaccagaaaaaggtggagttcaagatcgacatcgtggtgctggccttccagaaagcctctggcggaggcggaagtggaggcggaggatctggcggcggaggctctatctaccaggaactgacacaactgaaggccgccgtggaacggctgtgccacccttgtccttgggagtggaccttctttcagggcaactgctacttcatgagcaacagccagcggaactggcacgacagcatcaccgcctgcaaagaagtgggagcccaactggtcgtgattaagagcgccgaggaacagaacttcctccaactccagagcagcagaagcaacagattcacctggatgggcctgagcgacctgaaccaggaaggcacctggcagtgggtggacggatctcctctgctgcccagcttcaagcagtattggaaccggggcgagcccaacaacgtgggcgaagaggattgcgccgagttcagcggcaacggctggaacgacgacaagtgcaacctggctaagttctggatctgcaagaagtccgccgcctcctgtagccgggatgaggaacagttcctgagccctgcccctgccacccctaatcctccaccagctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2239 - DNA, 3306 bp, Artificial Sequence
  Synthetic Polynucleotide encoding a CAR with optional accessory module(s)
atggccttaccagtgaccgccttgctcctgccgctggccttgctgctccacgccgccaggccggaccacatcgtgctgacccagagccctagcagcctgtctgccagcctgggcgacagagtgaccatcagctgtagagccagccaggacatcagcacctacctgaactggtatcagcagaaacccgacggcaccgtgaagctgctgatcttctacaccagcagactgcacgccggggtgcccagcagattttctggcagcggctctggcacccaccacagcctgaccatctccaacctggaacaggaagatattgctacctacttctgtcagcaaggcaacagcctgcccttcaccttcggcagcggcaccaagctggaaatcaagagaggcggaggcggaagtggaggcggaggatctggcggcggaggctctcaggtgcagctgaaagagagcggccctgagctggaaaagcctggggccagcgtgaagattagctgcaaggccagcggctacagcttcaccgcctacagcatgaactgggtcaagcagaacaacggcatgagcctggaatggatcggcagcatcgacccctactacggcgacaccaaatacgcccagaagttcaagggcaaggccaccctgaccgtggataaggccagcagcaccgcctacctccagctgaagtctctgaccagcgaggacagcgccgtgtactactgcgccagacggatgattaccaccggcgactggtacttcgacgtgtggggagccggaaccaccgtgacagtgtctagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2240 - DNA, 3306 bp, Artificial Sequence; identical to SEQ ID NO: 2239
  Synthetic Polynucleotide encoding a CAR with optional accessory module(s)

SEQ ID NO: 2241 - DNA, 3147 bp, Artificial Sequence
  Synthetic Polynucleotide encoding a CAR with optional accessory module(s)
atggcccttccagtcactgccttgctgttgcctctggcgctcctgctccacgccgctagaccgggcatgagaaccgaggacctgcctaaggccgtggtgttcctggaaccccagtggtacagagtgctggaaaaggacagcgtgaccctgaagtgccagggcgcctacagccccgaggacaatagcacccagtggttccacaacgagagcctgatctccagccaggccagcagctacttcatcgacgccgccaccgtggacgacagcggcgagtatagatgccagaccaacctgagcaccctgagcgaccccgtgcagctggaagtgcacatcggatggctgctgctgcaggcccccagatgggtgttcaaagaagaggaccccatccacctgagatgccactcttggaagaacaccgccctgcacaaagtgacctacctgcagaacggcaagggcagaaagtacttccaccacaacagcgacttctacatccccaaggccaccctgaaggactccggctcctacttctgcagaggcctcgtgggcagcaagaacgtgtccagcgagacagtgaacatcaccatcacccagggcctggccgtgtctaccatcagcagctttttcccacccggctaccagacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2242 - DNA, 3147 bp, Artificial Sequence
  Synthetic Polynucleotide encoding a CAR with optional accessory module(s)
atggccttaccagtgaccgccttgctcctgccgctggccttgctgctccacgccgccaggccgggcatgcggactgaagacctcccaaaggctgtggtgttcctggagcctcaatggtacagggtgctggagaaggacagtgtgactctgaagtgccagggagcctactcccctgaggacaattccacacagtggtttcacaatgagagcctcatctcaagccaggcctccagctacttcattgacgctgccacagtggacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggcttgttgggagtaaaaatgtgtcttcagagactgtgaacatcaccatcactcaaggtttggcagtgtcaaccatctcatcattctttccacctggctaccaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2243 - DNA, 3306 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaagtgcagctggtggaatcaggcggcggactggtgcagcctggcagaagcctgagactgagctgtgccgccagcggcttcaccttcaacgactacgccatgcactgggtgcgccaggcccctggaaaaggactggaatgggtgtccacaatcagctggaacagcggcagcatcggctacgccgatagcgtgaagggccggttcaccatcagccgggacaacgccaagaagtccctgtacctccagatgaacagcctgcgggccgaggacacagccctgtactattgcgccaaggacatccagtacggcaactactactacggcatggacgtgtggggccagggaaccaccgtgaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2244 - DNA, 3312 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacccccctgagcctgcctgtgacacctggcgagcctgccagcatctcctgcagaagcagcaagagcctgctgcacagcaacggcatcacctacctgtactggtatctgcagaaacccggccagagcccccaactgctgatctaccagatgagcaacctggtgtccggcgtgcccgacagattttctggcagcggctccggcaccgacttcaccctgaagatcagccgggtggaagccgaggacgtgggcgtgtactactgcgcccagaacctggaactgccctacacctttggcggcggaacaaaggtggaaatcaagcggggcggaggcggaagtggaggcggaggatctggcggcggaggctctcaggtgcaactggtgcagagcggagccgaagtgaaaaagcccggcagcagcgtgaaggtgtcctgcaaggccagcggctacgccttcagctactcctggatcaactgggtgcgccaggcccctggacagggcctggaatggatgggcagaatcttccccggcgacggcgacaccgactacaacggcaagttcaagggcagagtgaccatcaccgccgacaagagcaccagcaccgcctacatggaactgagcagcctgcggagcgaggataccgccgtgtactattgtgccagaaacgtgttcgacggctactggctggtgtactggggccagggaacacttgtgaccgtgtccagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2245 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccatcatcacagcctctccaggcgagaaagtgaccatgacctgtagagccagcagcagcgtgaactacatggactggtatcagaagaagcccggcagcagccccaagccttggatctacgccacaagcaatctggcctctggcgtgcccagcagattttctggctctggcagcggcaccacctacagcatgacaatctctagcctggaagccgaggacgccgccacctactattgtcagcagtggtccttcaatcctcctaccttcggcggaggcaccaagctggaaatcaaaagaggcggaggcggaagtggaggcggaggatctggcggcggaggctctgaagttcagcttcagcagagcggagccgagctgaagaaacctggcgcttctgtgaaggtgtcctgcaaggccagcggctacacctttaccagctacaacatgcactgggtcaagcagaccccaggccagggactcgaatggatcggagccatctatcccggcaacggcgacacctcctacaaccagaagttcaagggcaagaccacactgaccgccgacaagagcagctccaccgcctacatggaactgagcagcctgagatccgaggataccgccgtgtactactgcgccagaagcaactactacggcagctcctactggttcttcgacgtgtggggcaccggcacaaccgtgacagtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2246 - DNA, 3312 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcgactggcccctgacatttggcggcggaacaaaggtggaaatcaaaggcggaggcggaagtggaggcggaggatctggcggcggaggctctgaagtgcaactggttcaatcaggtggcggcctggttcaccctggcggatctctgagactgtcttgtaccggcagcggcttcaccttcagctaccacgccatgcactgggtccgacaggcacctggaaaaggactggaatgggtgtccatcatcggcacaggcggcgtgacctactacgccgattctgtgaagggcagattcaccatcagccgggacaacgtgaagaacagcctgtacctccagatgaactccctgagagccgaggatatggccgtgtattattgcgccagagactactacggcgctggcagcttttacgacggcctgtacggaatggatgtgtggggccagggaaccaccgtgactgtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2247 - DNA, 3306 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacatttggcggaggcaccaaggtggaaatcaaaggcggaggcggaagtggaggcggaggatctggcggcggaggctctgctgtgcagctcgttgagtctggcggaggacttgttcagcctggcagatccctgagactgtcttgtgccgccagcggcttcaccttcggcgattacacaatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactattgcaccaaggacaaccagtacggctccggcagcacatacggacttggagtttggggccagggcaccctggttacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2248 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagcctctgatctacgcccctagcaatctggcctctggcgtgccaagcagattttctggcagcggctctggcaccgacttcaccctgacaatatccagcctccagcctgaggacttcgccacctactactgccagcagtggtccttcaatcctcctaccttcggccagggcaccaaggtggaaatcaaaagaggcggaggcggaagtggaggcggaggatctggcggcggaggctctgaagtgcagcttgttgaatctggcggcggactggttcagcctggcggatctctgagactgtcttgtgccgccagcggctacaccttcaccagctacaatatgcactgggtccgacaggcccctggcaaaggacttgaatgggtcggagccatctatcccggcaacggcgacacctcctacaaccagaagttcaagggcagattcaccatcagcgtggacaagagcaagaacaccctgtacctccagatgaactccctgagagccgaggacaccgccgtgtactattgtgccagagtggtgtactacagcaacagctactggtacttcgacgtgtggggccagggaaccctggtcacagtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2249 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggacatccagctcacacagagcccttctagcctgtctgccagcgtgggcgatagagtgaccatgacctgtagagccagcagcagcgtgtcctacatccactggttccagcagaagcctggcaaggcccctaagccttggatctacgccaccagcaatctggcctctggcgtgccagtcagattttctggcagcggctctggcaccgactacaccttcacaatatccagcctccagcctgaggacattgccacctactactgccagcagtggacctccaatcctcctacctttggcggaggcaccaagctggaaatcaaaggcggaggcggaagtggaggcggaggatctggcggcggaggctctcaggttcagctccagcagtctggggccgaagtgaagaaacctggcagctccgtgaaagtgtcctgcaaggccagcggctacacctttaccagctacaacatgcactgggtcaagcaggcccctggacagggactcgaatggatcggagccatctatcccggcaacggcgacacctcctacaaccagaagttcaagggcaaagccacactgaccgccgacgagagcacaaacaccgcctacatggaactgagcagcctgagaagcgaggacaccgccttctactactgtgcccggtctacctactacggcggcgactggtactttgacgtgtggggccagggaaccaccgtgacagtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2250 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccgagcaccgtgatgacacagagccctgatagcctggccgtgtctctgggagagagagccaccatcaactgcaagagcagccagagcaacagcaacgacgtggcctggtatcagcagaagccaggacagagccccaaggtgctgatctacttcgccagcaacagatacagcggcgtgcccgatagattttccggcagcggctacggcaccgacttcacccttacaatcagcagcctccaggccgaggatgtggccgtgtacttctgtcagcaagactacagcagccctctgacctttggagccggcaccaagctggaactgaaaagagctgacgctggcggaggcggaagtggaggcggaggatctggcggcggaggctctcagattcagctggtgcagtctggcagcgagctgaagaaacctggggcctctgtgaaggtgtcctgcaaggcttccggctacacctttaccaacttcggcgtgaactgggtccgacaggcccctggaaaaggactggaatggatgggctggatcaacacctacaccggcgagcctagctacgcccagggctttacaggcagattcgtgttcagcctggacgcctctgtgtctaccgcctacctccagatcagctccctgaaagccgaggacaccgccacctatttctgcaccagacggaccaactactacgggacctcctactactacgctatggactactggggccagggcaccaccgtgacagtgtctagcgccaagacaaccacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2251 - DNA, 3309 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctggcggaggcggaagtggaggcggaggatctggcggcggaggctctcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2252 - DNA, 3303 bp, Artificial Sequence; identical to SEQ ID NO: 2248
  Synthetic Polynucleotide encoding a CAR with optional accessory module(s)

SEQ ID NO: 2253 - DNA, 3300 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagcccttctagcctgtctgccagcgtgggcgacagagtgaccatcacatgtagagccagcagcagcctgagcttcatgcactggtatcagcagaagcccggcaaggcccctaagccttggatctacgccaccagcaatctggcctctggcgtgccaagcagattttctggcagcggctctggcaccgactacaccctgacaatatccagcctccagcctgaggacttcgccacctacttttgccaccagtggtccagcaatcctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaggcttccggctacacctttaccagctacaatatgcactgggtccgacaggctcccggccagagacttgaatggatcggagccatctatcccggcaacggcgacacctcctacaaccagaaattcaagggccgcgtgaccgtgaccagagacacatctgccaacaccgcctacatggaactgtctagcctgaagtccgaggacaccgccgtgtactactgtgccagaagccactacggcagcaactacgtggactacttcgactactggggccagggcacactggtcacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2254 - DNA, 3306 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaggtgcagcttgttgagtctggcggaggactggtgcagcccgatagaagcctgagactgtcttgtgccgccagcggcttcaccttccacgattatgccatgcactgggtccgacaggcccctggcaaaggacttgaatgggtgtccaccatctcttggaacagcggcacaatcggctacgccgactctgtgaagggcagattcaccatcagccgggacaacgccaagaacagcctgtacctccagatgaactccctgagagccgaggacacagccctgtactactgcgccaaggacatccagtacggcaactactactacggcatggacgtgtggggccagggcacaacagtgacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2255 - DNA, 3300 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagccagcagcagcgtgccctacatccactggtatcagcagaagcctggacaggcccctcggctgctgatctatgccacatctgctctggcctctggcatccccgatagattttctggcagcggctccggcaccgacttcaccctgacaatcagcagactggaacccgaggacttcgccgtgtactactgtcagcagtggctgagcaaccctcctacattcggccagggcaccaagctggaactgaaaagaggcggaggcggaagtggaggcggaggatctggcggcggaggctctgaagttcagctggttcagagcggagccgaagtgaagaagccaggcgagagcctgaagctgagctgcaaaggcagcggcagaaccttcaccagctacaacatgcactgggtccgacagatgcccggcaaaggactggaatggatgggcgctatctaccctctgaccggcgacacctcctacaaccagaaaagcaagctgcaagtgaccatcagcgccgacaagagcatcagcacagcctacctccagtggtcctctctgaaggccagcgacaccgccatgtactattgtgccagaagcacctacgtcggcggcgactggcagtttgatgtgtggggcaagggcaccaccgtgaccgtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2256 - DNA, 3315 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtcggagcagccagagcatcgtgcactccgtgggcaacaccttcctggaatggtatcagcagaagcccggcaaggcccccaagctgctgatctacaaggtgtccaacagattcagcggcgtgcccagcaggtttagcggctctggcagcggcaccgacttcaccctgaccatctctagcctccagcccgaggacttcgccacctactactgttttcaaggcagccagttcccctacaccttcggccagggaacaaaggtggaaatcaagcggggcggaggcggaagtggaggcggaggatctggcggcggaggctctgaagtgcaactggtggaaagcggaggcggcctggtgcagcctggcggatctctgagactgagctgtgccgccagcggctacgagttcagccggtcctggatgaactgggtgcgccaggcccctggcaagggactggaatgggtgggaagaatctaccccggcgacggcgacaccaactacagcggcaagttcaagggccggttcaccatcagcgccgacaccagcaagaacaccgcctacctccagatgaacagcctgcgggccgaggataccgccgtgtactactgtgccagagatggcagctcctgggactggtacttcgacgtgtggggacagggaacccttgtgaccgtgtccagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2257 - DNA, 3291 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccagcagcctgtctgccagcgtgggcgacagagtgaccatcacatgcaaggccagccagagcgtgaccaacgacgtggcctggtatcagcagaagcccggcaaggcccccaagctgctgatctactacgccagcaacagatacaccggcgtgcccagcagattcagcggctctggcagcggcaccgacttcaccctgaccatctctagcctccagcccgaggacttcgccacctactactgtcagcaggactacagaagcccctggaccttcggcggaggcaccaaggtggaaatcaagcggggcggaggcggaagtggaggcggaggatctggcggcggaggctctcaggtgcaactggaagaaagcgggggaggcgtcgtgcggcctggaagaagtctgagactgagctgtgccgccagcggcttcaccttcagcgactacggcgtgaactggatcagacaggcccctggcaagggcctggaatgggtcacaatcatctggggcgacggcagaaccgactacaacagcgccctgaagtcccggttcaccgtgtcccggaacaacagcaacaacaccctgagcctccagatgaacagcctgaccaccgaggacaccgccgtgtactactgtgtgcgggctcccggcaaccgggctatggaatattggggacagggcgtactcgtgaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2258 - DNA, 3309 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagggcggaggcggaagtggaggcggaggatctggcggcggaggctctcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2259 - DNA, 3309 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcggcggaggcggaagtggaggcggaggatctggcggcggaggctctgacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2260 - DNA, 3288 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccgccaccatcgagaacacaagcctgtctgccagcgtgggcgacagagtgaccatcacctgtagagccagccagggcatcagctcttggctgacctggtatcagcagaagcccgagaaggcccccaagagcctgatctacgccgccagctctctgcagtctggcgtgcccagcagattttccggcagcggctctggcaccgacttcaccctgacaatcagcagcctgcagcccgaggacttcgccacctactactgccagcagtacgacagctaccccatcaccttcggccagggcacccggctggaaatcaagggcggaggcggaagtggaggcggaggatctggcggcggaggctctcaggtgcaactgcagcagtggggagccggactgctgaagcctagcgagacactgagcctgacctgcgccgtgtacggcggcagcttcagcgcctactattggagctggatcagacagccccctggcaagggcctggaatggatcggcgacatcaatcacggcggaggcaccaactacaaccccagcctgaagtcccgcgtgaccatctccgtggacaccagcaagaaccagttctccctgaagctgaacagcgtgacagccgccgacacagccgtgtactactgtgccagcctgaccgcctattggggccagggatctcttgtgaccgtgtccagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2261 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacccagagccctgatagcctggccgtgtctctgggcgagagagccaccatcaactgcaaggccagccagagcgtggacttcgacggcgacagctacctgaactggtatcagcagaagcccggccagccccccaaggtgctgatctatgccgccagcacactgcagagcggcgtgcccagcagattttctggcagcggctccggcaccgacttcaccctgaccatcaacagcctggaagccgaggacgccgccacctactactgccagcagagcaacgaggacccctggacctttggcggcggaacaaaggtggaaatcaagggcggaggcggaagtggaggcggaggatctggcggcggaggctctcaggtgcaactggtgcagtccggcgctgaagtgaagaaacctggggccagcgtgaaggtgtcctgcaaggtgtccggctacacctttaccgactactacattacctgggtgcgccaggcccctggacaggccctggaatggatgggctggatctaccccggcagcggcaacaccaagtacagccagaagttccagggcagattcgtgttcagcgtggacaccagcgccagcaccgcctacctgcaactgtctagcctgaaggccgaagataccgccgtgtactactgcgccaactacggcaactattggttcgcctattggggccagggaacccttgtgaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2262 - DNA, 3294 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtgcagtctggcggagggctggtgcatcctgggggaagcctgagactgagctgtgccggctctggcttcgccttcagcagcagcaccatgcactggatcagacaggcccctggcaagggcctggaatggatcagcctgatcggaagcggagggggcatctactacggcgacagcgtgaagggccggttcaccatcagccgggacaacgccaagaacagcctgtacctccagatgaactccctgcgggccgaggacatggccgtgtactattgtgtgcggggctacttcgactgggtggactacttcgattactggggccagggcaccctcgtgaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2263 - DNA, 3324 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgatgacacagtcaccagatagcctcaccgtctccctgggggagcggaccaccattaattgtaaatccagccaaagcgtgctggactcaagcaagaacaagaatagcctcgcctggtatcagcagaagcccggtcagcctccaaagctgctgctttcttgggcctccaccagagagtccgggattcctgataggtttagtggttcaggctccggcacagattttactctgaccattgattctctccagccagaggattctgcaacttattactgccagcaaagcgcccactttcctataacttttggccagggaacccgacttgaaatcaagggcggaggcggaagtggaggcggaggatctggcggcggaggctctcaggtgcagctggtgcagagcggtgccgaagtgaagaaaccaggtgcatccgttaaagtttcatgtaaggctagtggatataccttcaccaattacggaatgaactgggtgaaacaggcccctggccagggactgaagtggatggggtggattaacacctacaccggggagccgacttatgcagacgactttaaggggcgggtcacgatgacctccgacacctccaccagtaccgcctacctggagctgcacaaccttaggtcagacgataccgccgtgtattactgtgcccgatggtcttggtccgacggatactatgtctacttcgactattggggccaggggaccacagttaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2264 - DNA, 3312 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctggaagcctggccgtgtctcctggcgagcgcgtgacaatgagctgcaagagcagccagagcgtgttcttcagcagctcccagaagaactacctggcctggtatcagcagatccccggccagagccccagactgctgatctactgggccagcaccagagaaagcggcgtgcccgatagattcaccggcagcggctctggcaccgacttcaccctgacaatcagcagcgtgcagcccgaggacctggctatctactactgccaccagtacctgagcagccggaccttcggccagggcaccaagctggaaatcaagagaggcggaggcggaagtggaggcggaggatctggcggcggaggctctcaggtgcaactgcagcagcctggcgctgaggtcgtgaagccaggcgcttccgtgaagatgtcctgcaaggccagcggctacaccttcaccagctactacatccactggatcaagcagacccctggacagggcctggaatgggtgggagtgatctaccccggcaacgacgacatcagctacaaccagaagttccagggcaaggccaccctgaccgccgacaagtctagcaccaccgcctacatgcaactgtccagcctgaccagcgaggacagcgccgtgtactactgcgccagagaagtgcggctgcggtacttcgatgtgtggggccagggaaccaccgtgaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2265 - DNA, 3390 bp, Artificial Sequence
  Synthetic Polynucleotide encoding a CAR with optional accessory module(s)
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatccagctgacacagagcccttctagcctgtctgccagcgtgggcgacagagtgaccatcacatgtagagccagccagggcatcagctctgtgctggcttggtatcagcagaagcctggcaaggcccctaagctgctgatctacgatgccagcagcctggaaagcggcgtgccaagcagattttctggcagcggctctggcaccgacttcaccctgacaatatccagcctccagcctgaggacttcgccacctactactgccagcagttcaacagcagcatcaccttcggccagggcaccaagctggaaatcaagagaacagtggcagccggcggaggcggaagtggaggcggaggatctggcggcggaggctctcaagttcagctggttcagtctggggccgaagtgaagaaacctggcagcagcgtgaaggtgtcctgcaaagcaagcggcggcaccttcagcgattacgccatctcttgggtccgacaggcccctggacaaggactggaatggatgggcagaatcatccccatcctgggcgtcgccaattacgcccagaaattccagggccgcgtgacaatcaccgccgacaagtctaccagaaccgcctacatggaactgagcagcctgagaagcgaggacaccgccgtgtactactgcgccagaaattgggccgacgccttcgacatttggggccagggaacaatggtcaccgtgtctagcgcctccacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2266 - DNA, 3387 bp, Artificial Sequence
  Synthetic Polynucleotide encoding a CAR with optional accessory module(s)
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatcgtgatgacacagagccctagcagcctgtctgcctctctcggcggcaaagtgaccatcacatgcaaggccagccaggacatcaacaagtatatcgcctggtatcagcacaagcccggcaagggacctagactgctgatccactacaccagcacactccagcctggcatccccagcagattttctggcagcggctccggcagagactacagcttcagcatcagcaacctggaacctgaggacattgccacctactactgcctccagtacgacaacctgctgacctttggagccggcaccaagctggaactgaaaagaggcggaggcggaagtggaggcggaggatctggcggcggaggctctgaagtgaaactccagcagagcggccctgagctggttaagcctggcaccagcgtgaaggtgtcctgtaaagccagcggctactccttcaccgactacaacatgtactgggtcaagcagagccacggcaagagcctggaatggatcggctacatcgacccctacaaaggcggcaccatctacaaccagaagttcaagggcaaagccacactgaccgtggacaagagcagcagcaccgccttcatgcacctgaacagcctgaccagcgaggacagcgccgtgtactattgcgccagagagatgattaccgcctactacttcgactactggggccagggaagcagcgtgaccgttagctctctggaaagaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2267 - DNA, 3435 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagatagagtgaccatcaactgcaaggccagccaggacatcaacagctacctgagctggttccagcagaagcctggcaaggcccctaagacactgatctaccgggccaacagactggtggatggcgtgccaagcagattttctggcagcggcagcggccaggattacaccctgacaatatccagcctccagcctgaggacttcgccacctactactgcctccagtacgacgagttccctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaagccagcggctacacctttaccaactacgacatcaactgggtccgacaggctccaggccaaggactggaatggatcggctggatctatcctggcgacggcagcaccaagtacaacgagaagttcaaggccaaggccacactgaccgccgataccagcacaagcaccgcctacatggaactgcggagcctgagaagcgacgacaccgccgtgtactattgtgcctccggctacgaggacgctatggactattggggccagggcaccaccgtgacagtgtctagtgccaagcctaccaccacaccagctccaagacctccaactcctgctcctacaatcgccagccagcctctgtctctcagacccgaagcctgtagacctgctgctggcggagctgtgcataccagaggactggatttcgcctgcgacatcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2268 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctctgagcctgcctgttacacctggcgagcctgccagcatctcctgtagaagctctcagagcctgctgcacagcaacggctacaactacctggactggtatctccagaagcctggacagagcccacagctcctgatctacctgggcgtgaactctgtgtccggcgtgcccgatagattttctggcagcggctctggcaccgacttcaccctgaagatcagcagagtggaagccgaggacgtgggcgtgtactactgtatgcaggccctccagacaccttggacattcggccagggcaccaaggtggaaatcaaaggcggcggaggatctggcggaggtggaagtggcggaggcggatctcaagtgcaactggttcagagcggagccgaagtgaagaaacctggcagcagcgtgaaggtgtcctgcaaagcctctggcggcatcttcagcaaccacgccatctcttgggtccgacaggctcctggacaaggactggaatggatgggcggcatcatccccatcttcggcacagccaattacgcccagaaattccagggcagagtgaccatcaccgccgacgagtctaccagcaccgccttcatggaactgagcagcctgagaagcgaggacaccgccgtgtactattgcgccagagaatgggccgacgtgttcgacatttggggccagggaacaatggtcaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2269 - DNA, 3300 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagtctccagccagcctgaccgtgtcactgggacagagagccaccatctcttgcagagccagcgagagcgtggacagctacggcaatagctacctgcactggtatcagcagaagcccggccagcctcctcagctcctgatctacctggcctccaatctggaaagcggcgtgccagccagattttctggcagcggcagcagaaccgacttcaccctgaccattgatcccgtggaagccgatgatgccgccacctactactgccagcagaacaacgaggacccctggacatttggcggaggcaccaaggtggaaatcaaaggcggcggaggatctggcggaggtggaagtggcggaggcggatctgaagttcagctccagcagagcggagccgagcttgtgaaacctggcgcttccgtgaagatgagctgcaaagccttcggctacaccttcaccacctttccaatcgagtggatgaagcagagccacggcaagagcctggaatggatcggcaactttcacccctacaacgaccagaccaagtacaacgaagagttcaagggcagagccaagctgaccatcgacagatccagcagcaccgtgtacctggaactgggcagactgacctccgatgacagcgccgtgtactactgtgccagaggctactactacgccttcgacttttggggccagggcaccacactgacagtgtctagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2270 - DNA, 3291 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatcagaaacgacctcggctggtatcagcagaagcctggcaaggcccctaagcggctgatctatgccgcttcctctctgcaatctggcgtgcccagcagattttctggcagcggctctggcaccgagttcaccctgacaatatccagcctccagcctgaggacttcgccacctactactgcctccagcacaacagctacccctggacctttggacagggcaccaagctggaaatcaaaggcggaggcggaagtggaggcggaggatctggcggcggaggctctgaagtgcaactggttgaatctggcggcgctctgattcagcctggcggatctctgagactgagctgtgtggcctccggctttaccatcagcggcaactacatgagctgggtccgacaggcccctggcaaaggacttgaatgggtgtccctgatctacagcggcgacagcacctattacgccgacagcgtgaagggcagattcaccatcagccgggacatcagcaagaacaccgtgtacctccagatgaactccctgagagtggaagataccgccgtgtactactgcgtccgcgacggctactacgtgtccgatatggttgtgtggggcaagggcaccaccgtgacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2271 - DNA, 3321 bp, Artificial Sequence
  Synthetic Polynucleotide encoding a CAR with optional accessory module(s)
atggccttaccagtgaccgccttgctcctgccgctggccttgctgctccacgccgccaggccggatgtgctgctgacccagagccctctgagcctgcctgtgacactgggacagcctgccagcatctcctgtcggagcagccagaccatcgtgcacagcaacggcaacacctacctggaatggttccagcagcggccaggccagagccccagactgctgatctaccaggtgtccaacagattcagcggcgtgcccgacagattctccggcagcggctctggcaccgacttcaccctgaagatcagccgggtggaagccgaggacgtgggcgtgtactactgttttcaaggcagccacgtgccccggacctttggcggaggaacaaaggtggaaatcaagagaggcggaggcggaagtggaggcggaggatctggcggcggaggctctcagatccaactggtgcagagcggcagcgagctgaagaaacctggggccagcgtgaaggtgtcctgcaaggccagcggctacacctttaccaactacggcatgaactgggtgcgccaggcccctggacagggcctgaaatggatgggctggatcaacaccaacaccggcgagcctaagtacgccgaagagttcaagggcagattcgccctgagcctggacaccagcgtgtccacagcctacctccagatcaacagcctgaaggccgaggataccgccgtgtacttctgcgccagaggctacggcaactacgccagaggggcttggctggcctattggggccagggaacactcgtgaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2272 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccacactctctctgagccctggcgaaagagccaccctgagctgtagcgccagcagcagcatcaactacatctactggctccagcagaagcccggccaggcccccagaatcctgatctacctgaccagcaacctggcctccggcgtgccagccagattttctggcagcggctccggcaccgacttcaccctgacaatcagcagcctggaacccgaggacttcgccgtgtactactgcctccagtggtccagcaaccccctgacctttggcggaggcaccaaggtggaaatcaagggcggaggcggaagtggaggcggaggatctggcggcggaggctctttcgaagtgcaactggtggaaagcgggggaggacttgtgaagcctggcggctctctgagactgagctgtgccgcctctggcttcaccttcagcagctacgacatgagctgggtgcgccaggctcctggcaagggactggaatgggtgtccaccatcagcagcggcggcagctacacctactacctggacagcatcaagggccggttcaccatctccagagacaacgccaagaacagcctgtacctccagatgaactccctgcgggccgaggacacagccgtgtattattgcgccagacagggcctggattactggggcagaggcacccttgtgaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2273 - DNA, 3306 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgccgggccagcaagagcgtgtccaccagcggctacagcttcatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagaggtgccctggacattcggccagggcacaaaggtggaaatcaagcggggcggaggcggaagtggaggcggaggatctggcggcggaggctctcaggtgcagctggtgcagtctggggccgaagtgaagaaacctggggccagcgtgaaggtgtcctgcaaggccagcggatacacctttaccaactacggcatgaactgggtgcgccaggcccctggacagggcctggaatggatgggctggatcaacacctacaccggcgagcccacatacgccgacgccttcaagggcagattcgccttcagcctggacaccagcacctccaccgcctacctccagatcaacagcctgcggagcgacgacaccgccgtgtattattgcgccagagattacggcgactacgggatggactattggggccagggaaccaccgtgaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2274 - DNA, 3294 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacccccctgaccctgagcgtgacaatcggacagcctgccagcatctcctgcaagagcagccagagcctgctggacagcgacggcaagacctacctgaactggctgctgcagaggccaggccagagccccgagagactgatctacctggtgtccaagctggactccggcgtgcccgatagattcacaggcagcggctccggcaccgacttcaccctgaagatcagccgggtggaagccgaggacctgggcgtgtactgttgttggcagggcacccacttcccttacaccttcggcggagggaccaaggtggaaatcaagggcggcggaggcggaagtggaggcggaggatctggcggcggaggctctcaggtgcaactgcagcagcctggcgctgaacttgtgcggccaggcgcctctgtgaagctgagctgtaaagccagcggctacaccttcaccagctactggatgaactgggtcaagcagcgcccaggccagggcctggaatggatcggaatgatcgaccccagcgacagcgagacacactacaaccacatcttcaaggacaaggccaccctgaccgtggacaagtccagcagcacagcctacctgcaactgtccagcctgaccagcgaggacagcgccgtgtactactgcgcccggaacctgtatctgtggggccagggaacaagcgtgaccgtgtctagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2275 - DNA, 3306 bp, Artificial Sequence
  Synthetic Polynucleotide encoding a CAR with optional accessory module(s)
atggccttaccagtgaccgccttgctcctgccgctggccttgctgctccacgccgccaggccggacgacatccagttgacccagtcccccagctcactcagcgccagtgtgggggaccgggtgaccattacctgtaaagccagtcagagtgtggactatgagggggatagcttcctgaattggtatcagcagaagcctggcaaagccccaaagctgctgatctacgctgcatctaatctggagtcaggcgtgccttctaggttctccggtagtgggtctgggaccgatttcacattgaccatttcatccctccaacccgaggatttcgctacatattactgtcagcagtccaatgaggaccctctcacctttggccagggcaccaaagttgaaattaagagaggcggaggcggaagtggaggcggaggatctggcggcggaggctctgaagtccaacttgtggagtctggagggggcctggtgcagcccggcggctctctcagactgtcttgtgcggcaagcggctacaccttcagctcttactggatagaatgggtgaggcaggcacctggaaagggactggagtggattggagagattctgccaggagggggagatacaaattacaatgaaatcttcaaggggcgggccaccttttcagcggataccagcaagaatacagcttacctgcagatgaatagcctccgggcagaagataccgctgtttattattgcacgagacgggtgccaataagactggactattgggggcaagggactcttgtcaccgtcagttcaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2276 - DNA, 3294 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacacctctgagcctgagcgtgacacctggacagcctgccagcattagctgcaagagcagccagtctctgctggacggcgacggcaagacctacctgaattggctgctccagaagcctggacagagccctcagcggctgatctacctggtgtccaagctggatagcggcgtgcccgatagattttctggcagcggctctggcaccgacttcaccctgaagatcagcagagtggaagccgaggacgtgggcgtgtactactgttggcagggcacacacttccccagaacattcggccagggcacaaagctggaaatcaaaggcggaggcggaagtggaggcggaggatctggcggcggaggctctcaagtgcaactggttcagagcggagccgaagtgaagaaacctggggcctctgtgaaggtgtcctgcaaggccagcggctacaccttcaaggacacctacatccactgggtccgacaggcccctggacaaggacttgagtggatgggcagaatcgaccccgccaacggcaacaccaaatacgaccccaagttccagggcagagtgaccatgaccagagacaccagcatcagcaccgcctacatggaactgagccggctgagatccgatgacaccgccgtgtactattgcgctagaagaggcggagtggattggggccagggaacactggttaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2277 - DNA, 3318 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgcgagagcagccagagcctgctgaacagcggcaaccagaagaactacctgacctggtatcagcagaagcccggccagccccccaagcccctgatctattgggccagcaccagagaaagcggcgtgcccgatagattcagcggcagcggaagcggcaccgacttcaccctgaccatcagttctcttcaggccgaggacgtggccgtgtactactgccagaacgactacagctacccctacaccttcggccagggcaccaagctggaaatcaagagaggcggaggcggaagtggaggcggaggatctggcggcggaggctctgaagtgcagctggtgcagtctggggccgaagtgaagaagcctggcgagagcctgaagatcagctgcaagggcagcggctacagcttcaccgactactacatgaagtgggccagacagatgcccggcaagggcctggaatggatgggcgacatcatccccagcaacggggccaccttctacaaccagaaattcaagggccaagtgaccatctccgccgacaagagcatcagcaccacctacctccagtggtccagcctgaaggccagcgacaccgccatgtactattgcgccagaagccatctgctgcgggccagttggttcgcctattggggccagggaacaatggtcacagtgtccagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2278 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaaggcggaggcggaagtggaggcggaggatctggcggcggaggctctcagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2279 - DNA, 3315 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctgaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2280 - DNA, 3315 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2281 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcaggactacggcttcccttggacctttggacagggcaccaaggtggaaatcaagagaggcggaggcggaagtggaggcggaggatctggcggcggaggctctgaagttcaactggttcagagcggagccgaagtgaagaagcctggcgagagcctgaagattagctgcaaaggctccggctactccttcaccagctactggatctcttgggtccgacagatgcccggcaaaggactggaatggatgggcatcatcgaccccagcgacagcgacaccagatacagccctagcttccagggccaagtgaccatcagcgccgacaagagcatcagcacagcctacctccagtggtcctctctgaaggccagcgataccgccatgtactattgcgccagaggcgacggcagcaccgacctggattattggggacagggaaccctggtcaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2282 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccgcagttcgtgctgacacagcctccaagcgtgtccaccaatcctggcagcacagtgaagctgagctgcaagagaaacaccggcaacatcggcagcaactacgtgaactggtatcagcagaagcccggacagagccccaccaccatgatctacagagatgacaagaggcccgacggcgtgcccgatagattttccggctctatcgacagaagcagcaacagcgccctgctgaccatcaacaacgtgcagacagaggacgaggccgactacttctgccagagctacagcagcggcatcaacatcatcttcggcggaggcaccaagctgacagttcttggcggaggcggaagtggaggcggaggatctggcggcggaggctctcaagtgcagctccaagaatctggccctggcctggtcaagcctagcgagacactgagcctgacctgtaccgtgtccggctttagcctgaccacctacgacgtgcactgggtccgacaacctccaggcaaaggactggaatggatgggcagaatccagaacgccggcatcaccgactacaatagcgccctgaagtcccggctgattatctccagagacaccagcaagagccaggtgttcctgaagatgaacagcgtgaccaccgccgacaccgccatgtacttttgtgccaagaccggcagctacttctacgccttcgatcactggggccagggcacactggttaccgtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2283 - DNA, 3294 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagtctccagccagcctgtctgcctctctgggagagacagtgaccatcgagtgcagacccagcgaggacatccacagcaacgtggcctggtatcagcagaagcccggcaattctccccagctgctgatctacgacgccagcaatctggctgatggcgtgcccagcagattttctggcagcggctctggcacacagtacagcctgaagatcaacagcctccagagcgaggacgtggcctcctacttctgccaccagtacaacatctacccctacaccttcggcagcggcaccaagctggaacttaaaggcggaggcggaagtggaggcggaggatctggcggcggaggctctcaagttcagctgcaagagtctggccccacactggtcaagcctggcgatagcgtgaagatgagctgcaaggccagcggctacacctttaccgactacatcatccactgggtcaagcagagccacggcaagagcctggaatggatcggctacatcaacccttacagcgacggcaccaactacaacgagaagttcaagagcaaggccacactgaccgtggacaagagcaccagcacagcctacatggaattttcccggctgacctccgaggacagcgccatctatttctgcgccctgaactacggcagctactacgctatggatgcctggggccagggcacaagcgtgacagtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2284 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacctttggacagggcaccaaggtggaaatcaagagaggcggaggcggaagtggaggcggaggatctggcggcggaggctctgaagttcagctccttgagagtggtggcggcctggttcaacctggcggatctctgagactgtcttgtgccgccagcggcttcacctttagcggctattggatgcactgggtccgacaggcccctggcaaaggacttgaatgggtgtccgccatcagaagcgacggcagcagcaagtactacgccgactctgtgaagggcagattcaccatcagccgggacaacagcaagaacaccctgtacctccagatgaacagcctgagagccgaggacacagccgtgtattattgcgccaaggacggcgtgatcgaggacacctttgattactggggccagggcaccctggtcaccgtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2285 - DNA, 3285 bp, Artificial Sequence
  Synthetic Polynucleotide encoding a CAR with optional accessory module(s)
atggccttaccagtgaccgccttgctcctgccgctggccttgctgctccacgccgccaggccggacgtgcagatcacacagagccctagctacctggctgcctctcctggcgagacaatcaccatcaactgtcgggccagcaagagcatcagcaaggacctggcctggtatcaagagaagcccggcaagaccaacaagctgctgatctacagcggcagcacactccagtctggcatccccagcagattttccggctctggcagcggcaccgatttcaccctgaccataagcagcctggaacctgaggacttcgccatgtactactgccagcagcacaacaagtacccctacacctttggcggaggcaccaagctggaaatcaagagaggcggaggcggaagtggaggcggaggatctggcggcggaggctctcaagttcaactgcaacagcctggggccgagcttgttagacctggcgcttctgtgaagctgagctgcaaggccagcggctacaccttcaccagctactggatgaactgggtcaagcagcggcctgaccagggcctcgaatggatcggcagaatcgacccctacgacagcgagacacactacaaccagaagttcaaggacaaggccatcctgaccgtggacaagagcagctccaccgcctacatgcaactgagcagcctgacctctgaggatagcgccgtgtactattgcgccagaggcaactgggacgactattggggccagggcacaaccctgacagtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2286 - DNA, 3378 bp, Artificial Sequence
  Synthetic Polynucleotide encoding a CAR with optional accessory module(s)
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatccagatgacacagtctccagccagcctgtctgcctctctgggagagacagtgaccatcgagtgccggaccagcaaggacatctacagcaacctggcctggttccagcaagagcccggcaattctcctcagctcctgatctacgacgccagcaatctggctgatggcgtgcccagcagattttctggcagcggctctggcacacagtacagcctccagatcaacaacctccagagcgaggacgtggcctcctacttctgccaccagtacaacaactacccctacaccttcggcaccggcaccaagctggaacttaaaggcggaggcggaagtggaggcggaggatctggcggcggaggctctcaagtgcagctccaagagtctggccccacactggtcaatcctggcgacagcgtgaagatgagctgcaaggccagcggctacacctttaccgaccacatcatccactgggtcaagcagagccacggcaagagcctggaatggatcggctacatcaacccctatagcggcggagccaactacaacggcaagttcaagagcaaggccacactgacaatcgacaagagcagcagcaccgcctacatggaattttccagactgaccagcggcgactccgccatctactactgcgccctgaattacggcagctactacgctatggatgcctggggccagggcacaagcgtgacagtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2287 - DNA, 3291 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctaccagcatgacagcctctccaggcgagcaagtgaccatcacctgtagagccagcagcagcatcaactacatgcactggtatcagcagaagcctggcgcaagccccagaccttggatctacgagacaagcaagctggcctccggcgtgcccgatagattttctggatctgccagcggcaccagctacagcctgaccatcaacaacatggaagccgaggacgccgccacctactactgccagcagtggaattacccctcctggacctttggcggaggcaccaagctggaacttaaaggcggaggcggaagtggaggcggaggatctggcggcggaggctctgaagtgcagctcgttgagtctggtggcggactggttcagcctggaagaagcctgaagctgagctgtgccgccagcggcttcaccttcagcgactacaatatggcctgggtccgacaggcccctaagaaaggactggaatgggtcgccaccatcctgtacgatggcggcagaacctactaccggggcagcgtgaagggcagattcaccatcagcagagacaacgccaagagcaccctgtacctgcggatggactctctgagaagcgaggataccgccacatattactgtgccacacacagccggggcaccgactactttgattattggggccagggcgtgatggttaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2288 - DNA, 3318 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacacagagcccttctagcctggccgtgtctgagggcgagacagtgaccatcaactgcaagagcagccagagcttcctgtctagcggcgacggcaagaattacgtggcctggtatcagtacaagcccggacagagccccaagctgctgatctactgggccagcacaagacagagcggcgtgcccgatagattcatcggctctggcagcggcaccgacttcaccctgacaatctctacagtgcaggccgaggacctggctatctactactgccagcagtattacgacacccctctgacctttggctccggcaccaagctggaaatcaaaggcggaggcggaagtggaggcggaggatctggcggcggaggctctgaagtgaagctgcaagagtctggccccagcctggtgcagagtagccaaacactgagcctgacctgtaccgtgtccggctttagcctgaccagctaccacatccactgggtccgacagacccctggcaaaggactggaatggatgggcgtgatgtggagcgacggcgacaccagctataacagcgccctgaagtcccggctgagcatcagcagagatacaagccagagccaggtgttcctgaagatgaacagcctccagaccgaggacaccgccacctactattgtgccagaggctactacagcagctacctgtacctttggttcgcctattggggccagggcaccctggttacagtcagctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2289 - DNA, 3330 bp, Artificial Sequence
  Synthetic Polynucleotide encoding a CAR with optional accessory module(s)
atggccttaccagtgaccgccttgctcctgccgctggccttgctgctccacgccgccaggccggacgtgctgatgacccagacacctgtgtctctgccagtgtctctcggaggccaggtgtccatctcctgtagaagcagccagagcctggtgcactccgacggcgatacctacctgcactggtatctccagaagcctggacagagccctcagctcctgatctaccgggtgtccaacagattcagcggcgtgcccgatagattttccggcagcggctctggcaccgacttcaccctgaagatcagcagagtggaacccgaggacctgggcctgtactactgtctccagaccacacacttcccaccttggacctttggcggaggcaccaagctggaaatgaaaggcggaggcggaagtggaggcggaggatctggcggcggaggctctcaggttcagctccagcagtctggacccgagcttagaaggccaggatctagcgtcagactgagctgcaaggccagcggctaccggatcaaggacttcctgatccactggattaagaacagacccgagcacggcctggaatggatcggatggattgaccctgaggacggcgagactaagtacgcccagaagttccagaccaaggccacactgaccgccgacacctctagcaacaccgcctacatgcaactgagcagcctgaccagcgaggacaccgccacctacttttgtgctagatggggcgacgtgtactacggcctgatgagaggccatgtgatggatgcctggggccagggaacaagcgtgacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2290 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagtctaccagttccctgagtgcatccctcggagacagggtgacgatcagttgcagcgcaagccaagggatcaataactatctgaactggtatcagcagaaaccggacggaacagtcgaactcctgatttattacaccagcacccttcagagtggcgtcccttcccggttcagtggctccggaagcgggaccgattactccctgaccatttctaatctggagccagaggacataggaacgtattattgccagcagtatagtaaactgccacgaacttttggaggggggacgaaactggagatcaaaggcggaggcggaagtggaggcggaggatctggcggcggaggctctcaggtgcaactccagcagtccggaagcgagcttatgatgccaggggcatcagtgaagatcagctgcaaggctactggctacaccttctctaattactggatagagtgggttaaacaaaggccagggcacggcctggaatggatcggcgagatcctgcctgggacaggccgaaccatttataacgagaagttcaaaggcaaggctactttcaccgcagatataagctctaatacagtgcaaatgcagctctcttccctgacaagtgaggatagtgccgtgtattattgcgcacgaagagattactatggaaatttttattacgctatggattattggggtcaaggaacaagtgtgaccgttagcagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2291 - DNA, 3288 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccctgccagcctgtccgtgtctgtgggcgagacagtgaccatcacctgtcgggccagcgagaacatctacagcaacctggcctggtatcagcagaagcagggcaagagcccccaactgctggtgtacgccgccaccaatctggccgatggcgtgcccagcagattttccggctctggcagcggcacccagtacagcctgaagatcaacagcctccagagcgaggacttcggcagctactactgccagcacttctggggcacctggacctttggaggaggcaccaccctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccgactactacatgaagtggatgaagcagagccacggcaagtccctggaatggatcggcgacatcaaccccaacaacggcggcaccacctacaaccagaagttcaagggcaaggccaccctgaccgtggacaagagcagcagcaccgcctacatgcaactgaacagcctgaccagcgaggacagcgccgtgtactactgcgccagagactacggctacggctatttcgactactggggccagggcacaaccctgacagtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2292 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggcctctcagagcgtgggaggctacctggcttggtatcagcagaagccaggccaggcccccagactgctgatctacgacgccagcaatcgggccacaggcatccccgccagattttctggcagcggctccggcaccgacttcaccctgacaatcagcagcctggaacccgaggacttcgccgtgtactactgccagcagcggaacaactggccccccatgtacacattcggccagggcaccaagctggaaatcaagagaggcggaggcggaagtggaggcggaggatctggcggcggaggctctcaggtgcaactggtgcagagcggagccgaagtgaagaaacccggcagcagcgtgaaggtgtcctgcaaggcttccggcggcaccttcagcagctacgccatttcttgggtgcgccaggctcctggacagggcctggaatggatgggcggcatcatccctatcctgggcaccgccaactacgcccagaaattccagggcagagtgaccatcaccgccgacgagagcaccagcaccgcctacatggaactgagcagcctgcggagcgaggacacagccgtgtattattgcgccagatggggcggaggggccttcgacatttggggccagggaacaatggtcaccgtgtccagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2293 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgacacagagccctgccctgatgagcgccagccctggcgagaaagtgaccatgacctgtagcgccagcagcagcgtgcgctacatgtactggtatcagcagaagcccagaagcagccccaagccctggattcacctgaccagcaatctggcctctggcgtgcccgctagattttccggctctggcagcggcaccagctacagcctgaccatcagcagcatggaagccgaggacgccgccacctactactgccagcagtggtccagccaccccttcacatttggctccggcaccaagctggaaatcaagggcggaggcggaagtggaggcggaggatctggcggcggaggctctgatgtgcaactccaggaaagcggccctggccttgtgaagcctagccagagcctgtccctgacctgtaccgtgaccggcttcagcatcaccagcgactactcttggaactggatcagacagttccctggcaacaaactggaatggatgggctacatcagctactccggccacacctcctacaaccccagcctggaaagccggatctccatcaccagagacaccagcaagaaccagttcttcttgcaactgaacagcgtgaccaccgaggataccgccacatattactgtaccagaggcaactgggacgtggtgtactggggccagggcacacttgtgaccgtgtctgctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2294 - DNA, 3312 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagagccctctgagcctgcctgtgacactgggacagcctgccagcatctcctgtcggagcagccagagcatcgtgcacagcgacggcaacacctacctggaatggtatcagcagcggccaggccagagccccagacggctgatctacaaggtgtccaacagattcagcggcgtgcccgacagattctccggcagcggctctggcaccgacttcaccctgaagatcagcagagtggaagccgaggacgtgggcgtgtactactgttttcaaggcagccacgccccctggacctttggcggaggaacaaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagctacggaatgcactgggtgcgccaggcccctggcaaaggactggaatgggtggcctacatcaccaccagaagcagcaccatctactacgccgacagcgtgaagggccggttcaccatctccagagacaacgccaagaacagcctgtacctccagatgaactccctgcgggccgaggacaccgccgtgtactattgcaccagagagcccctgaccggctactacgctatggactattggggccagggcaccagcgtgaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2295 - DNA, 3288 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcctgtggctgaactggtatcagcagaagcccggcaaggcccccaagctgctgatctacgccgccagcacactccagagcggcgtgccaagcagattttccggcagcggctccggcaccgacttcaccctgacaatcagctccctccagcccgaggacttcgccacctactactgccagcagtactacaccagcccctacaccttcggccagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagctacgccatgagctgggtgcgccaggcccctggaaaaggactggaatgggtgtccgtgatccggtccagcggcagcagcacctattacgccgatagcgtgaagggccggttcaccatcagccgggacaacagcaagaacaccctgtacctccagatgaacagcctgcgggccgaggacaccgccgtgtactattgtgctaggggaggcggctacttcgactactggggccagggaacactcgtgaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2296 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgtgtccacactccagagcggcgtgcccagcagattttctggcagcggctccggcaccgacttcaccctgacaatcagctccctccagcccgaggacttcgccacctactactgtcagcagagcggcaccttccctcccaccacatttggacagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagccacggaatgcactgggtgcgccaggcccctggaaagggactggaatgggtgtccgtgatctccggcagcggcagcaataccggctacgccgatagcgtgaagggccggttcaccatcagccgggacaacagcaagaacaccctgtacctccagatgaacagcctgcgggccgaggacaccgccgtgtactattgtgccagacagtggggcagctacgccttcgattcttggggccagggcaccctcgtgaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2297 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgagccagagccctagcagcctggccgtgtccgtgggcgagaaagtgaccatgagctgcaagagcagccagtccctgctgcacagcagcaaccagaagaactacctggcctggtatcagcagaagcccggccagtcccccaaggtgctgatctactgggccagcaccagagaaagcggcgtgcccgatagattcaccggcagcggctctggcaccgacttcaccctgaccatcaccagcgtgaagtccgaggacctggctgtgtactactgccagcagtattacagctacccctggaccttcggcggaggcacccggctggaaatcaaaagaggcggaggcggaagtggaggcggaggatctggcggcggaggctctgaagtgcaactccagcagagcgtggccgagcttgtgaagcctggcgcttccgtgaagatgtcctgcaaggtgtccggctacaccctgacagaccacaccatccactggatgaagcagcggcctgagcagggcctggaatggatcggctacatctaccccagggacggcatcaccggctacaacgagaagttcaagggcaaggccacactgaccgccgacaccagcagcagcacagcctacatgcaactgaacagcctgaccagcgaggacagcgccgtgtacttctgtgccagatggggctacagctacagaaactacgcctactactacgactactggggccagggcacaaccctgaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2298 - DNA, 3318 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctacggaacaagcagcagagccaccggcatccccgacagattttctggcagcggctccggcaccgacttcaccctgacaatcagcagactggaacccgaggacttcgccgtgtactactgccagcagtacggcagcagccccttcacctttggcggaggcaccaaggtggaaatcaagagaggcggaggcggaagtggaggcggaggatctggcggcggaggctctcaggtgcaactccaggaatctggccccggactggctaagcccagcgagacactgagcctgacctgtaccgtgtccggcgacagcatcaccagctactactggtcctggatcagacagccccctggcaagggcctggaatggatcggctacatctactacagcggcagcaccaactacaaccccagcctgaagtccagagtgaccatcagcgtggacaccagcaagaaccagttctccctgaagctgagcagcgtgacagccgccgacaccgccgtgtattattgcgccagagatcagcggagaatcgccgctgccggcacccacttttacggcatggatgtgtggggccagggcaccaccgtgaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2299 - DNA, 3294 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacccagagccccgtgatcctgtccgtgtctcctggcgagagagtgtccttcagctgtcgggccagccagagcatcggcaccaacatccactggtatcagcagcggaccaacggcagccccagactgctgattaagtacgccagcgagtccatcagcggcatccccagcagattttccggcagcggctccggcaccgacttcaccctgagcatcaacagcgtggaaagcgaggacattgccgactactactgccagcagaacaacaactggcccaccaccttcggagccggcaccaagctggaactgaagggcggaggcggaagtggaggcggaggatctggcggcggaggctctcaggtgcagctgaagcagagcggacctggcctggtgcagcctagccagagcctgtccatcacctgtaccgtgtccggcttcagcctgaccaactacggcgtgcactgggtgcgccagagccctggaaaaggactggaatggctgggagtgatttggagcggcggcaacaccgactacaacacccccttcaccagcagactgtctatcaacaaggacaacagcaagagccaggtgttcttcaagatgaacagcctccagagcaacgacaccgccatctactactgtgctagagccctgacctactatgactacgagttcgcctactggggccagggcacactcgtgacagtgtctgctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2300 - DNA, 3273 bp, Artificial Sequence
  Synthetic Polynucleotide encoding a CAR with optional accessory module(s)
atggccttaccagtgaccgccttgctcctgccgctggccttgctgctccacgccgccaggccgatgacccagagccccaagttcctgctggtgtctgccggcgacagagtgaccctgacatgcaaggccagccagagcgtgaacaacgacgtgtactggtatcagcaggaacccggccagtcccccaagctgctgatctactgggccagcaccagagaaagcggcgtgcccgatagattcaccggcagcggctctggcaccgacttcaccctgacaatcagcagcgtgcaggccgaggacctggccgtgtactactgcaagcagagctacaacctgtacaccttcggcggaggcaccaagctggaaatcaagagaggcggcggaggatctggcggaggcggatctgggggcggaggctctgaatctggaagaggactggtgcagcctggcggcagcagaaagctgtcttgtgccgccagcggcttcaccttcagcaccagcggaatgcactgggtgcgccaggcccctgagaagggactggaatgggtggcctacatcagctccggcagcaccaccatctaccacgccgataccgtgaagggccggttcaccatcagccgggacaaccccaagaataccctgttcctccagatgaccagcctgcggagcgaggacaccgccatgtactattgctgcgccagaagcggccagttcggcaactacttcgactactggggccagggcaccaccctgaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2301 - DNA, 3288 bp, Artificial Sequence
  Synthetic Polynucleotide encoding a CAR with optional accessory module(s)
atggccttaccagtgaccgccttgctcctgccgctggccttgctgctccacgccgccaggccgcagagcccatctagcctggctgtgtctgccggcgagaaagtgaccatgagctgcaagagcagccagagcctgctgaacagccggacccggaagaactacctggcctggtatcagcagaagcccggccagagccccaagctgctgatctactgggccagcaccagagaaagcggcgtgcccgatagattcaccggctctggcagcggcaccgacttcaccctgacaatcagcagcgtgcaggccgaggacctggccgtgtactactgcaagcagagcaacctgtacaccttcggcggaggcaccaagctggaaatcaagggcggaggcggaagtggaggcggaggatctggcggcggaggctctcaggtgcagctggaagagtctggacccgagcttgtgaagcctggggccagcgtgaagctgtcctgtaaagccagcggctacaccttcaccgagtacatcatccactgggtcaagcagcggagcggccagggcctggaatggatcggctggttttaccctggctccggcagcatcaagtacaacgagaagttcaaggacaaggccaccctgaccgccgacaagtccagcagcaccgtgtacatggaactgagcggcctgaccagcgaggacagcgccgtgtatttctgcgccagacacgacggctacagctacttcgactattggggccagggcaccacactgaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2302 - DNA, 3324 bp, Artificial Sequence
  Synthetic Polynucleotide encoding a CAR with optional accessory module(s)
atggaaatgttccagggcctgctgctgctcctgctgctttctatgggaggcacatgggccagcagagagatgctgaggcccagatgcagacccatcaatgccacactggccgtggaaaaagagggctgccctgtctgcatcaccgtgaacaccacaatctgcgccggctactgccccaccatgacaagagttctgcaaggcgtgctgcccgctctgcctcaggtcgtgtgcaactatcgggacgtccgcttcgagagcatcagactgcctggatgtcccagaggcgtgaaccctgtggtgtcttatgccgtggctctgagctgtcagtgcgccctgtgtagaagaagcaccaccgattgcggcggacccaaggatcaccctctgacctgtgacgaccctagattccaggccagcagcagctctaaagcccctccaccttctctgccatctccaagcagactgcccggacctagcgacacacctattctgcctcaaggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2303 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgcctctctgggcgagagagtgtccctgacctgtcgggccacacaggaactgagcggctacctgtcttggctgcagcagaagcccgacggcaccatcaagcggctgatctacgccgccagcaccctggatagcggcgtgcccaagagattcagcggcaacagaagcggcagcgactacagcctgaccatcagctccctggaaagcgaggacttcgccgactactactgcctgcagtacgccatctacccctacaccttcggcggaggcaccaagctggaaatcaagggcggaggcggaagtggaggcggaggatctggcggcggaggctctgaggtgcaactgcagcagtctggccccgagcttgtgaagcctggcgcctccgtgaagatgagctgcaaggccagcggctacacctttaccagctacttcatccactgggtcaagcagaaacccggccagggcctggaatggatcggcttcatcaacccttacaacgacggcagcaagtacaacgagaagttcaagggcaaggccaccctgaccagcgacaagagcagcagcaccgcctacatggaactgtccagcctgacatccgaggacagcgccgtgtactactgcaccagggacgacggctactacggctacgccatggactactggggccagggaacaagcgtcaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2304 - DNA, 3312 bp, Artificial Sequence
  Synthetic Polynucleotide encoding a CAR with optional accessory module(s)
atggccttaccagtgaccgccttgctcctgccgctggccttgctgctccacgccgccaggccggacaccatcgtgctgacacagagccctgcttccctggccgtgtccctgggacagagagccaccatctcttgcagagccagcgagagcgtggacagctacggcaacagcttcatgcactggtatcagcagaagcccggccagccccccaagctgctgatctacctggcctccaacctggaaagcggcgtgcccgccagattttctggcagcggcagcagaaccgacttcaccctgaccatcgaccccgtggaagccgatgatgccgccacctactactgccagcagaacaactacgacccctggaccttcggcggaggcaccaagctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccagctacgtgatgcactgggtcaagcagaaacctggacagggcctggaatggatcggctacatcaacccctacaacgacggcaccaagtacaacgagaagttcaagggcaaggccaccctgacaagcgacaccagcagcagcaccgcctacatggaactgaacagcctgaccagcgaggacagcgccgtgtacttctgcgccagacccatctacttcgacaacgactacttcgattactggggccagggcaccaccctgaaggtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2305 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagccaggatgtgtctacagccgtggcctggttccagcagaagcctggaaaagcccctaagctgctgatctacagccccagctacagatacaccggcgtgcccagcagattttctggcagcggctctggcaccgacttcaccctgacaatatccagcctccagcctgaggacttcacctactactgccagcagctctacagcaccccttacacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaagccagcggctacacctttaccgactactacctggacgtggtcgtgcggcaagctcctggacaaggactggaatggatcggcagagtgaacccctacaacggcggcaccatctacaaccagaaattcaagggaagagtgaccctgaccagagacaccagcacctccacagcctacctggaactgagcagcctgagaagcgaagataccgccgtgtactactgcgccagggaccactacagatatgaccctctgctggactactggggccagggaaccctggttacagtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2306 - DNA, 3315 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagagcgtgtccaccagcagctacaactacatgcactggtatcagcagaagcccggcaagcctcctaagctgctgattaagtacgccagcaacctggaaagcggcgtgcccagcagattttctggcagcggctctggcaccgacttcaccctgacaatatccagcctccagcctgaggacttcgccacctactactgtcagcactcctgggagatccctctgacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggccagcggctacagcttcaccgactattatatgcactgggtccgacaggctccaggccagggacttgagtggatcggcagaatcaacccctacaacggcgctgccttctacagccagaacttcaaggatagagtgaccctgaccgtggacaccagcaccagcacagcctacctggaactgagcagcctgagaagcgaggacaccgccgtgtactactgcgccattgagagaggcgctgacctggaaggctacgctatggattattggggccagggaaccctggtcaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2307 - DNA, 3309 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctccagccacactgagcgcttctccaggcgagagagtgaccctgacctgtagagccagcagcaacgtgatctccagctacgtgcactggtatcagcagaagcctggcagcagccccagactgtttctgtacagcaccagcaatctggcctccggcgtgccaagcagattttctggctctggcagcggcaccgacttcacctttaccatctctagcctggaagccgaggacgccgccacctactactgtcagcagtacagcggctaccctctgaccttcggccagggcacaagactggaaatcaaaggcggaggcggaagtggaggcggaggatctggcggcggaggctctcaagttcagctgcaagagtctggccctggcctggtcaagcctagcgaaacactgagcctgacctgcgccgtgtctggctactctatcaccagcgcctactattggaactggatcagacagcctcctggcaaaggactggaatggatcggctacatcagctacgacggcagaaacaactacaaccccagcctgaagaaccggatcaccatcaatcccgacaccagcaagaaccagttcagcctccagctgaacagcgtgacccctgaggataccgccgtgtactactgtgccagagaaggcgactacgacgtgggcaactactacgctatggactactggggccagggaaccctggtcacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2308 - DNA, 3309 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcagcaacgtgatctccagctacgtgcactggtatcagcagaagcctggacaggcccctcggctgctgatctacagcacaagcaatctggcctctggcatccccgccagattttctggctctggaagcggcaccgacttcaccctgaccataagcagcctggaacctgaggacttcgccgtgtactactgccagcagtatagcggctaccctctgaccttcggccagggcacaagactggaaatcaaaggcggaggcggaagtggaggcggaggatctggcggcggaggctctgaagtgcaactggtggaaagtggcggcggactggtgcaacctggaagaagcctgagactgtcctgtgccgccagcggctactctatcacaagcgcctactactggaactgggtccgacaggctcctggcaaaggactggaatgggtgtcctacatcagctacgacggcagaaacaactacaaccccagcctgaagaaccgcttcaccatcagccgggacaacgccaagaagtccctgtacctccagatgaacagcctgagagccgaggacacagccctgtactattgcgccaaagagggcgactacgacgtcggcaactactacgctatggactactggggccagggaaccaccgtgactgtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2309 - DNA, 3345 bp, Artificial Sequence
  Synthetic Polynucleotide encoding a CAR with optional accessory module(s)
atggccttaccagtgaccgccttgctcctgccgctggccttgctgctccacgccgccaggccggacctgaacttcatgctgacccagccccacagcgtgtccggcagccctggaaagaccgtgaccatctcctgcaccagaagcaccggcagcatcaccagcaactacgtgcactggtatcagcagaggcccggcagcagccctaccaccgtgatctgcgaggacaacgagaggccaagcggcgtgcccgatagattcagcggctccatcgacatcagcagcaacagcgccagcctgaccatcagcggcctgaaaaccgaggacgaggccgactactactgccagagctacgacgacagcaaccacatctccgtgttcggcaccgggaccaaagtgaccgtgctgggacagcccaaggccaatcctggcggaggcggaagtggaggcggaggatctggcggcggaggctctcaggtgcaactgcaggaatctggccctggcctcgtgaagcccagcgagacactgagcctgacctgcacagtgtccggcggcagcattagcagcagcaattactactggggctggattcggcagccccctggcaagggactggaatggatcggagccatctactacagcggcagcacctactacaaccccagcctgaagtccagagtggctatcagcgtggacaccagcaagaaccagttctccctgaagctgagcagcgtgacagccgccgataccgccgtgtactactgcgccagacggatcggagtggccggacagtggtacttcgacctgtggggcagaggaaccctcgtgaccgtgtctagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2310 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgagcgccagcgtgggcgacagagtgaccatcacctgcaaggccagccaggacgtgggcatcgccgtggcctggtaccagcagaagcccggcaaggtgcccaagctgctgatctactgggccagcaccagacacaccggcgtgcccgacagattcagcggcagcggcagcggcaccgacttcaccctgaccatcagcagcctgcagcccgaggacgtggccacctactactgccagcagtacagcagctacccctacaccttcggccagggcaccaaggtggagatcaagggcggaggcggaagtggaggcggaggatctggcggcggaggctctcagatccagttggtgcagtctggacctgacctgaagaagcctggagagacagtcaagatcagttgcaaggcttctgggtataccttcacaaacactggaatgaactgggtgaagcaggctccaggaaagggtttaaagtggatgggctggataaatacctacactggagagccaacatacgctgatgacttcaagggacggtttaccttctctttggaaacctctgccagcactgcctatttgcagatcaacaacctcaaaaatgaggacacggctacatatttctgtacaagatggggctacggtagtagcctttattatgctatggactactggggtcaaggaacctcagtcaccgtctcctcaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2311 - DNA, 3294 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgggaatcgccgtggcctggtatcagcagaaacccggcaaggtgcccaagctgctgatctactgggccagcaccagacacaccggcgtgcccgatagattttccggcagcggctccggcaccgacttcaccctgacaatcagctccctccagcccgaggacgtggcaacctactactgccagcagtacagcagctacccctacaccttcggccagggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcgacttcagccggtactggatgagctgggtgcgccaggcccctggcaaaggactggaatggatcggcgagatcaaccccgacagcagcaccatcaactacgcccccagcctgaaggacaagttcatcatcagccgggacaacgccaagaacagcctgtacctccagatgaactccctgcgggccgaggacaccgccgtgtactattgcgccagacccgacggcaactactggtacttcgacgtgtggggccagggaaccctcgtgaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2312 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccagaagagcatgagcaccagcgtgggcgacagagtgagcatcacctgcaaggccagccaggacgtgatcaccggcgtggcctggtaccagcagaagcccggccagagccccaagctgctgatctacagcgccagctacagatacaccggcgtgcccgacagattcaccggcagcggcagcggcaccgacttcaccttcaccatcagcaacgtgcaggccgaggacctggccgtgtactactgccagcagcactacagcacccccctgaccttcggcgccggcaccaagctggagctgaagggcggaggcggaagtggaggcggaggatctggcggcggaggctctcaggtgcagctgcagcagcccggcgccgagctggtgagacccggcgccagcgtgaagctgagctgcaaggccagcggctacagcttcaccacctactggatgaactgggtgaagcagagacccggccagggcctggagtggatcggcatgatccaccccagcgacagcgagaccagactgaaccagaagttcaaggacaaggccaccctgaccgtggacaagagcagcagcaccgcctacatgcagctgagcagccccaccagcgaggacagcgccgtgtactactgcgccagaagcaccatgatcgccaccagagccatggactactggggccagggcaccagcgtgaccgtgagcagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2313 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagccaggatgtgtctacagccgtggcctggtatcagcagaagcctggaaaggcccctaagctgctgatctacagcgccagctacagatacaccggcgtgcccgatagattcacaggctctggcagcggcaccgacttcaccctgacaatatctagcctccagcctgaggacttcgccacctactactgccagcagcactacagcacccctccatacacatttggcggaggcaccaaggtggaaatcaagagaggcggaggcggaagtggaggcggaggatctggcggcggaggctctcaagttcaactggttcagagcggagccgaagtgaagaaacctggggcctctgtgaaggtgtcctgcaaagccagcggctacgcctttagcagctcctggatgaactgggtccgacaggctcctggacagggcctcgaatggatcggcagaatctatcctggcgacggcgacaccaagtacaacggcaagttcaagggcaaagccacactgaccgccgacaagagcacaagcaccgcctacatggaactgagcagcctgagaagcgaggacaccgccgtgtactactgtgccagatccaccatgatcgccaccggcgctatggattattggggccagggaaccctggtcaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2314 - DNA, 3306 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagacacctctgagcctgagcgtgacacctggacagcctgccagcatcagctgtagaagcagccagagcctggtgcacaacaacggcaacacctacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacacacgtgccaccttacacctttggcggaggcaccaaggtggaaatcaaaggcggaggcggaagtggaggcggaggatctggcggcggaggctctgaagtgcagctggttgagtctggtggcggactggttcaacctggcggaagcctgagactgtcttgtgccgccagcggcttcaccttcagcgactactatatggcctgggtccgacaggcccctggcaaaggacttgaatgggtcgccgagatcaactacgacggcagcagcacctactacgtggacagcgtgaagggcagattcaccatcagccgggacaacgccaagaacagcctgtacctccagatgaactccctgagagccgaggataccgccgtgtactactgcgccagagacagaggcttctacttcgactattggggccagggcaccaccgtgacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2315 - DNA, 3306 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagacacctctgagcctgagcgtgacacctggacagcctgccagcatctcctgtagaagcagccagagcctggtgcacagcaacggcctgacatacctgcactggtatctccagaagcctggacagagccctcagctcctgatctacaaggtgtccaacagattcagcggcgtgcccgacagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccagcatcaactacgacggcgagagcacctactacgtggacagcgtgaagggcagattcaccatcagccgggacaacgccaagaacagcctgtacctccagatgaactccctgagagccgaggataccgccgtgtactactgcgccagagacagaggctactacttcgactattggggccagggcaccaccgtgacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2316 - DNA, 3306 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagccctctgagcctgcctgtgacacctggcgaacctgccagcatctcctgtagaagcagccagagcctggtgcacagcaacggcaatacctacctgcactggtatctccagaagcctggacagagcccacagctcctgatctacaaggtgtccaaccggttcagcggcgtgcccgatagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccgacatcaactacgatggcggcagcacctactacctggacagcctgaagtcccggttcaccatctccagagacaacgccaagaacagcctgtacctccagatgaactccctgagagccgaggataccgccgtgtactactgcgccagagacagaggctactacttcgactattggggccagggcaccctggtcacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2317 - DNA, 3300 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagcagcagctacctgagcgtgtcccttggcggcagagtgaccatcacctgtaaagccagcgaccacatcaacaactggctggcctggtatcagcagaagcctggcaacgcccctagactgctgattagcggagccacctctctggaaacaggcgtgccaagcagattttccggcagcggctctggcaaggactacaccctgagcatcaccagcctccagaccgaggatgtggctacctactactgccagcagtattggagcaccccttggacctttggcggaggcaccaagctggaaatcaaaggcggaggcggaagtggaggcggaggatctggcggcggaggctctcaggttcagctccagcagtctggcgctgagcttgctagacctggcgcttctgtgaagctgagctgcaaggccagcggctacaccttcaccagctactggatgcagtgggtcaagcagaggccaggccaaggactggaatggatcggagccatctatcccggcgacggcgataccagatacacccagaagttcaagggcaaagccacactgaccgccgacaagagcagctccacagcctacatgcaactgagcagcctggcttccgaggacagcgccgtgtactattgtgccagaggcaaggtgtactacggcagcaaccctttcgcctattggggccagggaaccctggttacagtgtctgctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2318 - DNA, 3300 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccacaagttcatgagcaccagcgtgggcgacagagtgtccatcacctgtaaagccagccaggacgtgtcaacagccgtggcctggtatcagcagaagcctggacagagccccaagctgctgatctacagcgccagctacagatacaccggcgtgcccgatagattcacaggctctggcagcggcaccgacttcacctttacaatcagcagcgtgcaggccgaggacctggccgtgtattattgccagcagcactacagcacccctccatacacatttggcggaggcaccaagctggaaatcaaaggcggaggcggaagtggaggcggaggatctggcggcggaggctctcaggttcagctccagcagtctggccctgagcttgtgaaacctggcgcttccgtgaagattagctgcaaggccagcggctacgccttcagcagctcctggatgaactgggtcaagcagaggccaggccagggcctcgaatggatcggcagaatctatcctggcgacggcgacaccaagtacaacggcaagttcaagggcaaagccacactgaccgccgacaagtctagcagcaccgcctatatgcagctcagcagcctgacctctgtggacagcgccgtgtacttctgtgcccggtctaccatgattgccaccggcgctatggattactggggccagggaacaagcgtgaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2319 - DNA, 3315 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgtgccacagtggaagccggcctgagcggctctgtgtttggcggcggaacaaagctgaccgtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgcgccatcgtgggcagcttcagccctctgacactgggcctgtggggccagggaactatggtcaccgtgtccagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2320 - DNA, 3315 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgccagagctacgacagcagcagcatcagcaccatcttcggcggaggcaccaagctgacagtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgtgccatcgtgggcagcttcagcggaatcgcctacagaccttggggccagggcacaatggtcaccgtgtctagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2321 - DNA, 3348 bp, Artificial Sequence
  Synthetic Polynucleotide encoding a CAR with optional accessory module(s)
atggccttaccagtgaccgccttgctcctgccgctggccttgctgctccacgccgccaggccggacgaattcgaggtgcagctggtagaatccggcgggggacttgtacaggctggtggtagtctgagactgagctgtgtggcctccggcatcagcagcagcaagcggaacatgggatggtataggcaagcccctggtaagcagagggaatccgtggctacaatcagcagcggcggcaacaaggactacaccgacgccgtgaaggacaggttcaccatctccagggacaccaccaagaacaccgtgtacctgcagatgaactccctcaagcccgaggacaccgccgtgtactactgcaagatcgaggccggcacaggctgggccaccagaagaggctacacatactgggggcagggaacactggtgaccgtgagctccctcgagggcggaggcggaagtggaggcggaggatctggcggcggaggctctttcgaagttcaactggtggaatccggtggaggactggtgcaagcgggcggctcactgcgccttagctgtgctgccagcggcagtatcttcagcggcaatgtaatgggttggtacaggcgacaagccccaggcaaggagcgagagtgggtagccgcgattgcaagtgggggcagcatctactacagagattctgtgaaaggccgcttcactattagtcgggacaacgcaaaaaacacggtgtatctccaaatgaacagcttgaagccagaggacactgctgtctactattgtaacagtcatcccccaactctcccctattgggggctgggcactcaggtcaccgtgagttccacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2322 - DNA, 3450 bp, Artificial Sequence
  Synthetic Polynucleotide encoding a CAR with optional accessory module(s)
atggccttaccagtgaccgccttgctcctgccgctggccttgctgctccacgccgccaggccggacgaattcgaggtgcaactggtggaaagcggcggaggactggtgcaggctggcgatagcctgagactgagctgtgccgcctccggcagagccttcagcagatatgccatgggctggttcagacaggcccctggcaaagaacgcgagttcgtggccgccatcggctggggacctagcaagaccaactacgccgacagcgtgaagggccggttcaccatcagccgggacaacgccaagaacaccgtgtacctgcagatgaacaccctgaagcccgaggacaccgccgtgtactcttgcgccgccaagttcgtgaacaccgacagcacctggtcccgcagcgagatgtacacctattggggccagggcaccctcgtgaccgtgtctagtctcgagggaggaggcggctccgggggaggcggaagtggaggcggaggatctgggtctggaggaagcggatctggaggctcagggtcagggggctcaggcagtggaggctctttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2323 - DNA, 3309 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagcgccagcagcagcgtgtcctacatgtactggtatcagcagaagcccggcaaggcccccaagctgctgatctacctgaccagcaatctggcctccggcgtgcccagcagattttctggcagcggctccggcaccgacttcaccctgacaatcagctccctccagcccgaggacttcgccacctactactgtcagcagtggcggagcaaccccttcaccttcggccagggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcacaagcggcatgggcgtgggctggatcagacagcctcctggaaaggccctggaatggctggcccacatttggtgggacgacgtgaagcggtacagccccagcctgaagtcccggctgaccattaccaaggacaccagcaagaaccaggtggtgctgaccatgacaaacatggaccccgtggacaccgccacatattactgcgcccggatcgtgtccttcgacaacgacgtggtgtccgctatggactactggggccagggaaccctcgtgaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2324 - DNA, 3294 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtccgtgtctccaggcgaaagagccaccctgagctgcaaggcttcccagagcgtgtccaacgacgtcgtgtggtatcagcagaagcccggccaggcccccagactgctgatctactacgccagcaacagatacaccggcatccccgccagattcagcggctctggcagcggcaccgagttcaccctgacaatcagcagcctccagagcgaggacttcgccgtgtactactgtcagcaggactacaccagcccctggaccttcggccagggcaccaagctggaaatcaagagaggcggaggcggaagtggaggcggaggatctggcggcggaggctctcaggtgcaactggtgcagagcggagccgaagtgaagaaacctggggccagcgtgaaggtgtcctgcaaggccagcggctacacctttaccaactacggcatgaactgggtgcgccaggctcctggacagggcctggaatggatgggctggatcaacacctacaccggcgagcccacctacgccgacgacttcaagggcagagtgaccatgaccaccgacaccagcacctccaccgcctacatggaactgcggagcctgagaagcgacgacaccgccgtgtattattgcgcccggatcggcgacagcagccccagcgattattggggccagggaaccctcgtgaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2325 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggacagcaccgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacctggccagcaacctgcagagcggcgtgcccagcagattttctggcagcggctccggcaccgacttcaccctgacaatcagctccctgcagcccgaggacttcgccacctactactgtcagcaggccgagtacatgcccctgaccttcggccagggaacaaaggtggaaatcaagagagccggcggaggcggaagtggaggcggaggatctggcggcggaggctctgaagtgcaactgctggaatctggcggcggactggtgcagcctggcggatctctgagactgagctgtgccgccagcggcttcacctttagcggctacgccatgagctgggtgcgccaggctcctggcaaaggcctggaatgggtgtccgagatcgcccctcccggcctgaataccagatacgccgatagcgtgaagggccggttcaccatcagccgggacaacagcaagaacaccctgtacctgcagatgaacagcctgcgggccgaggataccgccgtgtactactgcgccaagagcgacaccgccttcgactactggggacagggaacccttgtgaccgtgtccacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2326 - DNA, 3306 bp, Artificial Sequence
  Synthetic Polynucleotide encoding a CAR with optional accessory module(s)
atggccttaccagtgaccgccttgctcctgccgctggccttgctgctccacgccgccaggccggaccaggccgtgctgacccaggagagcgccctgaccaccagccccggcgagaccgtgaccctgacctgcagaagcagcaccggcgccgtgaccaccagcaactacgccaactgggtgcaggagaagcccgaccacctgttcaccggcctgatcggcggcaccaacaacagagtgcccggcgtgcccgccagattcagcggcagcctgatcggcgacaaggccgccctgaccatcaccggcgcccagaccgaggacgaggccatctacttctgcgtgctgtggcacagcaaccactgggtgttcggcggcggcaccaagctgaccgtgctgggcggaggcggaagtggaggcggaggatctggcggcggaggctctgacgtgcagctggtggagagcggcggcggcctggtgcagcccggcggcagcagaaagctgagctgcgccgccagcggcttcaccttcagcagcttcgggatgcactgggtgagacaggcccccgagaagggcctggagtgggtggcctacatcagcagcggcagcagcaccctgcactacgccgacaccgtgaagggcagattcaccatcagcagagacaaccccaagaacaccctgttcctgcagatgaccagcctgagaagcgaggacaccgccatgtactactgcgccagatggggcaactacccccactacgctatggactactggggccagggcaccagcgtgaccgtgagcagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2327 - DNA, 2952 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcaactggtggaaagcggcggaggctctgtgcagacaggcggctctctgagactgacctgtgccgccagcggcagaaccagcagatcctatggcatgggctggttcagacaggcccctggcaaagaacgcgagttcgtgtccggcatctcttggagaggcgacagcaccggctacgccgatagcgtgaagggccggttcaccatcagccgggacaacgccaagaacaccgtggacctgcagatgaacagcctgaagcccgaggacaccgccatctactactgtgccgctgccgccggatctgcttggtacggcacactgtacgagtacgactactggggccagggcacccttgtgaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2328 - DNA, 3378 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcaactggtggaaagcggcggaggctctgtgcagacaggcggctctctgagactgacctgtgccgccagcggcagaaccagcagatcctatggcatgggctggttcagacaggcccctggcaaagaacgcgagttcgtgtccggcatctcttggagaggcgacagcaccggctacgccgatagcgtgaagggccggttcaccatcagccgggacaacgccaagaacaccgtggacctgcagatgaacagcctgaagcccgaggacaccgccatctactactgtgccgctgccgccggatctgcttggtacggcacactgtacgagtacgactactggggccagggcacccttgtgaccgtgtcatctctcgagggcggaggcggaagtggaggcggaggatctggcggcggaggctctttcgaagaggtgcaactggtggaatccgggggaggcagcgtgcaggctgggggatcactgagactgtcttgtgctgcctccggcgacacctacggcagctattggatgggatggtttcggcaggctcccggaaaagaacgggaaggcgtggccgccatcaacagaggcggcggatacaccgtgtacgccgactctgtgaagggcagattcacaatctccagagacacagccaagaatactgtgtacctgcagatgaactccctgcgccccgacgataccgccgactattattgcgccgcttccggcgtgctgggcggcctgcatgaggactggttcaattattggggacagggaacacttgtgacagtgtccagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2329 - DNA, 3435 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcagctcgtagaatctggaggtggttccgtgcaagccggaggatcattgcgactgacctgcgcagcgagcggatctacttctcgctcttacggtatgggatggttcagacaggctcctgggaaagagcgcgagttcgtttcaggcatctcctggaggggggacagcaccggctacgcagatagcgtgaagggcaggttcacgatcagccgagacaacgccaaaaacaccgtcgatctgcaaatgaatagtctgaagcccgaagatactgcgatctactactgtgccgccgcagcagggtccacctggtacggcacactctacgagtacgactactgggggcagggaaccctggtaaccgtgtcctctctcgagggaggaggcggctccgggggaggcggaagtggaggcggaggatctgggtctggaggaagcggatctggaggctcagggtcagggggctcaggcagtggaggctctttcgaagttcagctcgtggaaagcggtggcggaagtgtgcaggccggaggcagtttgcgcctgagctgcgctgcttccggcgatacatacgggtcttactggatgggctggtttaggcaggcacctggacaagaaagagaagctgtggccgctattaacaggggaggtggctataccgtttatgctgattccgtgaagggccgattcacaatctcccgggataacgccaaaaacactctgtacctgcagatgaactcccttaggcccgatgacacagccgattactattgtgcggcctccggcgtgctgggtggtctgcatgaggattggttcaactactgggggcaaggcaccctcgtaaccgtgagtagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2330 - DNA, 3279 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagaaacaacctggcctggtatcagcagaagcccggcaaggcccccaagcggctgatctacgccgccagcaatctccagagcggcgtgcccagcagattcacaggctctggcagcggcaccgagttcaccctgatcgtgtctagcctccagcccgaggacttcgccacctactactgcctccagcaccacagctaccccctgacatctggcggaggcaccaaggtggaaggcggaggcggaagtggaggcggaggatctggcggcggaggctctgaggtgcaggtgctggaaagtggcggaggactggtgcagcctggcggctctctgagactgtcttgtgccgccagcggcttcaccttcagcagctacgccatgagctgggtgcgccaggcccctggaaaaggactggaatgggtgtccgccatcagcggctctggcgggtctaccaactacgccgatagcgtgaagggccggttcaccatcagccgggacaacagcaagaacaccctgtacctccagatgaacagcctgcgggccgaggacaccgccgtgtattattgtgccggcagcagcgggtggagcgagtattggggacagggcaccctcgtgaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2331 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggacgagatccagctggtgcagagcggagccgaagtgaagaagcctggcgagagcctgcggatcagctgcaagggcagcggcttcaacatcgaggactactacatccactgggtgcgccagatgcccggcaagggcctggaatggatgggcagaatcgaccccgagaacgacgagactaagtacggccccatcttccagggccacgtgaccatcagcgccgacaccagcatcaacaccgtgtacctccagtggtccagcctgaaggccagcgacaccgccatgtactactgcgcctttagaggcggcgtgtactggggccagggcaccacagtgacagtgtctagcggcggaggcggaagtggaggcggaggatctggcggcggaggctctgatgtcgtgatgacccagagccccgacagcctggctgtgtctctgggagagagagccaccatcaactgcaagtccagccagtccctgctggacagcgacggcaagacctacctgaactggctccagcagaagcccggccagccccccaagagactgatctccctggtgtccaagctggactccggcgtgcccgatagattttccggctctggcagcggcaccgacttcaccctgacaatcagctcccttcaggccgaggacgtggccgtgtactattgctggcagggcacacacttccccggcacctttggcggaggcaccaaggtggaaatcaagacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2332 - DNA, 3318 bp, Artificial Sequence
  Synthetic Polynucleotide encoding a CAR with optional accessory module(s)
atggccttaccagtgaccgccttgctcctgccgctggccttgctgctccacgccgccaggccggacgagcttgtgatgacccagagccccagcagcctgacagtgacagccggcgagaaagtgaccatgagctgcaagagcagccagagcctgctgaacagcggcaaccagaagaactacctgacctggtatcagcagaagcccggccagccccccaagctgctgatctactgggccagcaccagagaaagcggcgtgcccgatagattcaccggctctggcagcggcaccgacttcaccctgacaatcagcagcgtgcaggccgaggacctggccgtgtactactgccagaacgactacagctaccccctgaccttcggagccggcaccaagctggaaatcaagggcggaggcggaagtggaggcggaggatctggcggcggaggctctgaagtgcagctgctggaacagtctggcgccgaacttgtgcggcctggcaccagcgtgaagatcagctgtaaagccagcggctacgccttcaccaactactggctgggctgggtcaagcagaggcctggacacggcctggaatggatcggcgacatctttcccggctccggcaacatccactacaacgagaagttcaagggcaaggccaccctgaccgccgacaagtctagcagcaccgcctacatgcagctgtccagcctgacctttgaggacagcgccgtgtatttctgtgcccggctgcggaactgggacgagcccatggattattggggccagggcaccaccgtgaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2333 - DNA, 3321 bp, Artificial Sequence
  Synthetic Polynucleotide encoding a CAR with optional accessory module(s)
atggccttaccagtgaccgccttgctcctgccgctggccttgctgctccacgccgccaggccggacgagctgcagatgacccagagccctagcagcctgtctgccagcgtgggcgacagagtgaccatcacctgtagagccagccagagcatcagcagctacctgaactggtatcagcagaagcccggccagccccccaaactgctgatctactgggccagcaccagagaaagcggcgtgcccgatagattcagcggcagcgagagcggcaccaactacaccctgaccatcagctccctgcagcccgaggacttcgccacctacttttgccagcagagcgacagcctgcccatcacctttggacagggcacccggctggacattcagggcggaggcggaagtggaggcggaggatctggcggcggaggctctgaggtgcaactgctggaatctgggggcggagtggtgcagcctggcagaagcctgagactgagctgtgccgccagcggcttcaccttcagctcctacggaatgcactgggtgcgccaggcccctggcaaaggactggaatgggtggccgtgatctcctacgacggcagcaacaagtactacgccgacagcgtgaagggccggttcaccatcagccgggacaacagcaagaacaccctgtacctgcagatgaacagcctgcgggccgaggacaccgccgtgtactactgcgccaaggatatgggctggggcagcggctggcggccttactactactacggcatggacgtgtggggccagggcaccaccgtgacagtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2334 - DNA, 3312 bp, Artificial Sequence
  Synthetic Polynucleotide encoding a CAR with optional accessory module(s)
atggccttaccagtgaccgccttgctcctgccgctggccttgctgctccacgccgccaggccggacgacatccaaatgacacagagtccttctagtttgagtgcgagcgtgggggacagggtgaccattacctgcagggccagccagagcataagctcataccttaattggtaccagcaaaaaccaggtaaggcccctaagctcctgatctacgcggcctcttcacttcaatctggggtcccttcccgcttcagtggctccggcagcggcaccgacttcacgctcactatatcaagtctgcagcctgaggatctcgccacctattactgtcaacaaagttattccacccctttcacctttggaccgggcacgaaagtggatattaagggcggaggcggaagtggaggcggaggatctggcggcggaggctctgtgcacgaggtccagcttgtgcagtccggggcagaggtcaagaagcctggttctagcgtaaaagtgagttgcaaagcctcaggtgggacattttcatcctacgcgatcagttgggttagacaggctcctggtcaagggctggaatggatgggcggaattattccaatcttcggaacagcgaattacgcgcagaagttccagggtagagtaaccatcactgctgacaagtccacctccaccgcatacatggaattgtctagtctccggagcgaggatacggcggtgtattattgtgctacgttcgccctgtttggcttccgcgaacaggctttcgacatctgggggcagggcacgacagtcacggttagtagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2335 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagacccctctgagcctgcctgtgtccctgggcgatcaggccagcatctcctgtagaagcagccagagcctggtgcacagcaacggcaacacctacctgcggtggtatctccagaagcccggccagagccccaaggtgctgatctacaaggtgtccaacagattcagcggcgtgcccgacagattctccggcagcggctctggcaccgacttcaccctgaagatcagccgggtggaagccgaggacctgggcgtgtacttctgtagccagagcacccacgtgccctggacctttggcggcggaacaaagctggaaatcaagggcggaggcggaagtggaggcggaggatctggcggcggaggctctgaagtgaagctggacgagacaggcggagggctggtgcagcctggcagacctatgaagctgagctgtgtggcctccggcttcaccttcagcgactactggatgaactgggtgcgccagtcccccgagaagggcctggaatgggtggcccagatcagaaacaagccctacaactacgaaacctactacagcgacagcgtgaagggccggttcaccatcagcagggacgacagcaagagcagcgtgtacctccagatgaacaacctgagggtggaagatatgggcatctactactgcaccggcagctactacggcatggactactggggccagggcaccagcgtgaccgtgtctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2336 - DNA, 3336 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagagcagcgccgacgacgccaagaaggacgccgccaaaaaggatgatgccaagaaagacgatgctaaaaaagacggcggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2337 - DNA, 3324 bp, Artificial Sequence
  Synthetic Polynucleotide encoding a CAR with optional accessory module(s)
atggccttaccagtgaccgccttgctcctgccgctggccttgctgctccacgccgccaggccgcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctggcggaggcggaagtggaggcggaggatctggcggcggaggctcttctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2338 - DNA, 3309 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagaaccagccagagcctgagcagctacacccactggtatcagcagaagcctggcaaggcccctaagctgctgatctatgccgcttccagcagaggcagcggagtgcctagcagattttctggcagcggctccggcaccgatttcaccctgacaatatccagcctccagcctgaggacttcgccacctactactgccagcagagcagaacattcggccagggcaccaaggtggaaatcaaaggcggaggcggaagtggaggcggaggatctggcggcggaggctctcaagttcagctccagcagtctggccctggcctggttaagcctagccagacactgagcctgacctgtgccatcagcggcgatagcgtgtccagctacaacgccgtgtggaactggatcagacagagcccatccagaggactggaatggctgggcagaacctactacagaagcggctggtacaacgactacgccgagagcgtgaagtcccggatcaccatcaatcccgacaccagcaagaaccagttcagcctgcaactgaacagcgtgacccctgaggataccgccgtgtactactgtgctagaagcggccacatcaccgtgttcggcgtgaacgtggacgccttcgatatgtggggccagggaacaatggtcaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2339 - DNA, 3306 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacccagagccctctgagcctggccgtgtctctgggacagcctgccatcatcagctgcaaggccagccagagcgtgtcctttgccggcacctctctgatgcactggtatcaccagaagcccggccagcagcccagactgctgatctacagagccagcaacctggaagccggcgtgcccgatagattttccggcagcggcagcaagaccgacttcaccctgaccatcagccccgtggaagccgaagatgccgccacctactactgccagcagagcagagagtacccctacaccttcggcggaggcaccaagctggaaatcaagaggggcggaggcggaagtggaggcggaggatctggcggcggaggctctcaggtccaactggtgcagagcggagccgaggtcgtgaagcctggcgcttccgtgaagattagctgcaaagccagcggctacacctttaccggctactttatgaactgggtcaagcagagccctggccagagcctggaatggatcggcagaatccacccctacgacggcgacaccttctacaaccagaagttccagggcaaggccaccctgacagtggacaagagcagcaacaccgcccacatggaactgctgagcctgaccagcgaggacttcgccgtgtactactgcaccagatacgacggcagccgggctatggactattggggccagggcaccaccgtgaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2340 - DNA, 3225 bp, Artificial Sequence
  Synthetic Polynucleotide encoding a CAR with optional accessory module(s)
atggccttaccagtgaccgccttgctcctgccgctggccttgctgctccacgccgccaggccgaacagctgcgagctgaccaacatcacaatcgccatcgagaaagaggaatgccggttctgcatcagcatcaacaccacttggtgcgccggctactgctacacccgcgatctggtgtataaggaccccgccagacctaagatccagaaaacctgcaccttcaaagagctggtctacgagacagtcagagtgcctggatgtgcccaccacgccgatagcctgtacacataccctgtggctacccagtgccactgcggcaagtgtgatagcgacagcaccgattgcaccgtcagaggactgggacccagctactgtagcttcggcgagatgaaggaaggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2341 - DNA, 3318 bp, Artificial Sequence
  Synthetic Polynucleotide encoding a CAR with optional accessory module(s)
atggccttaccagtgaccgccttgctcctgccgctggccttgctgctccacgccgccaggccggacctggaaaccaccctgacacagagccctgccaccctgagtgtgtccccaggcgagagagtgaccctgagctgtagagccagccagagcgtgggcagcaacctggcctggtatcagcagaagttcggccaggcccccagactgctgatctacgacgccagcacaagagccaccggcatccccgccagattttctggcagcggctccggcaccgagttcaccctgaccatcagcagactggaacccgaggacttcgccgtgtactactgccaccagtacggcagcagccccagaacctttggacagggcaccaaggtggacatcaagcggggcggaggcggaagtggaggcggaggatctggcggcggaggctctcaggtgcaactggtgcagagcggagccgaagtgaagaaacctggggccagcgtgaaggtgtcctgcaaggccagcggctacacctttaccacctacggcatctcttgggtgcgccaggctcctggacagggactggaatggatgggctggatcagcgcctacaacggccacaccaactacgcccagatgctccagggcagagtgaccatgaccaccgacaccagcacctccaccgcctacatggaactgcggggcctgagaagcgacgacaccgccgtgtattattgcgccagagaagcctacgcctcctacggcagcggcagctactggaccgattattggggccagggcaccctcgtgaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2342 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggacgacgttgtgatgacccagacccccctgagcctgcctgtgacacctggcgaacctgccagcatcagctgtcggagcagccagagcctggtgcacagaaacggcaacacctacctgcactggtatctccagaagcccggccagagccccaagctgctgatccacaaggtgtccaacagattcagcggcgtgcccgacagattctccggcagcggctctggcaccgacttcaccctgaagatcagccgggtggaagccgaggacctgggcgtgtacttctgtagccagagcacccatgtgccccccctgacatttggagccggcaccaagctggaactgaagggcggaggcggaagtggaggcggaggatctggcggcggaggctctgaagtgcagctggtgcagtctggcgctgaggtggaaaagcctggggccagcgtgaagattagctgcaaggccagcggcagcagcttcaccggctacaacatgaactgggtgcgccagaacatcggcaagagcctggaatggatcggagccatcgacccctactacggcggcaccagctacaaccagaagttcaagggcagagccaccctgaccgtggacaagagcaccagcaccgcctacatgcacctgaagtccctgcggagcgaggacaccgccgtgtactactgtgtgtccggcatggaatattggggccagggcaccagcgtgaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2343 - DNA, 3291 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgatgacccagacccctgccaccctgtctgtgtctgccggcgagagagtgaccattacctgcaaggccagccagagcgtgtccaacgacgtgacctggtatcagcagaagcccggccaggcccccagactgctgatctacagcgccagcaacagatacagcggcgtgcccgccagattttccggcagcggctacggcaccgagttcaccttcaccatcagcagcgtgcagagcgaggacttcgccgtgtacttctgtcagcaagactacagcagcttcggccagggcaccaagctggaaatcaagaggggcggaggcggaagtggaggcggaggatctggcggcggaggctctcaggtgcagctggtggaatctggacctggcgtggtgcagcctggcagaagcctgagaatcagctgtgccgtgtccggcttcagcgtgaccaactacggcgtgcactgggtgcgccagccacctggaaaaggactggaatggctgggcgtgatctgggctggcggcatcaccaactacaacagcgccttcatgtcccggctgaccatctccaaggacaacagcaagaacaccgtgtacctccagatgaacagcctgcgggccgaggacaccgccatgtactactgtgcttccagaggcggccactacggctacgccctggattattggggccagggaaccctcgtgaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2344 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagaccgccagcagcctgcctgcctctctgggcgacagagtgaccatctcctgtagcgccagccaggacatcagcaactacctgaactggtatcagcagaaacccgacggcaccgtgaagctgctgatcttctacagcagcaacctgcacagcggcgtgcccagcagattttctggcggcggaagcggcaccgactacagcctgaccatcagcaatctggaacccgaggacattgccacctacttttgccaccagtacagcaagctgccctggacctttggcggaggcaccaagctggaaatcaagagaggcggaggcggaagtggaggcggaggatctggcggcggaggctctgaagtgaccctggtggaaagcggcggagacttcgtgaagcctggcggctctctgaaggtgtcctgtgccgccagcggcttcgcctttagccactacgccatgagctgggtgcgccagacccctgccaagagactggaatgggtggcctacatcagcagcggcggctccggcacctactactccgatagcgtgaagggccggttcaccatcagccgggacaacgccaagaacaccctgtacctccagatgcggagcctgcggagcgaggacagcgccatgtatttctgcaccagagtgaagctgggcacctattacttcgactcttggggccagggcaccaccctgaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2345 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccgcagttcgtgctgacccagagcccttctgcctctgctgccctgggagcctctgccaagctgacctgtacactgagcagcgcccacaagacctacaccatcgactggtatcagcagcagaagggaaaggcccccagatacctgatccaagtgaagtccgacggcacctacacaaaggccaccggcgtgcccgatagattcagcggcagtagcagcggagccgatagatacctgattatccccagcgtgcaggccgacgacgaggccgattactactgcggcaccgattacaccggcggctacgtgttcggcggaggcacacaactgaccgtgacaggcggaggcggaagtggaggcggaggatctggcggcggaggctctgagcaactgaaagagtctggcggcggactgttcaagcccaccgataccctgaccctgacctgcaccgtgtccggcttcagcctgagctactacggcgtgaactgggtgcgccaggcccctggcaatggcctggaatggatcggcacaatcggcggcagcggcgacacctactatgcctcttgggccaagtccagaagcaccatcatcagaaacaccaacgagaacaccgtgaccctgaagatgaccagcctgacagccgccgacaccgccacctacttttgcgtcagatacgccaacatcggctacgagtatttcaacgtgtggggacccggcaccctcgtgaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2346 - DNA, 3318 bp, Artificial Sequence
  Synthetic Polynucleotide encoding a CAR with optional accessory module(s)
atggccttaccagtgaccgccttgctcctgccgctggccttgctgctccacgccgccaggccgcagttcgtgctgacccagagcccttctgtgtctgccgccctgggagcctctgccaagctgacctgtacactgagcagcgcccacaagacctacaccatcgactggtatcagcagcagcagggcgaggcccccagatacctgatgcaagtgaagtccgacggcagctacaccaagggcaccggcgtgcccgatagattcagcggcagtagcagcggagccgatagatacctgattatccccagcgtgcaggccgacgacgaggccggatatgtgtgcggcgctgacgacaatggcggctacgtgttcggcggaggcacccaactgacagtgacaggcggaggcggaagtggaggcggaggatctggcggcggaggctctcagagcgtgaaagagtctgagggcggcctgttcaagcccaccgataccctgaccctgacctgcaccgtgtccggcttcagcctgagcagacacgccctgacatgggtgcgccaggcccctggaaatggcctggaatggatcggagccatcgacaacgccggcaccacctactatgcctcttgggccaagtccagaagcaccatcacccggaacaccgacctgcacaccgtgaccctgaagatgaccagcctgaccgccagcgacaccgccacctacttttgcgccagagtgttctacgacatcaacagcggctactacctggacggcatggacctgtggggacctggcacacttgtgaccgtgtccagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2347 - DNA, 3300 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctacccccccacctttggcggaggcaccaaggtggaaatcaagggcggaggcggaagtggaggcggaggatctggcggcggaggctctgaagtgcaactggtggaatcaggcggcggactggtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacttcggcatggacgtgtggggccacggcaccaccgtgacagtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2348 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtggaatccgggggaggctctgtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacgacttcggcatggacgtgtggggccagggcacaaccgtgacagtgtctagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2349 - DNA, 3300 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctccatctgcctctggcacacctggacagagagtgaccatcagctgtagcggcagcagaagcaacgtcggcggcaactacgtgttctggtatcagcaggtcccaggcgctacccctaagctgctgatctacagaagcaatcagcggcctagcggcgtgcccgatagatttgccggaagcaagagcggcagctctgccagccttgccatctctggactgagaagcgaggacgaggccgactactactgtgccacctgggatgatagcctgagcggcttcgtgtttggcaccggcaccaaagtgacagtgcttggtggcggaggcggaagtggaggcggaggatctggcggcggaggctctgaagttcagctggttgaatctggcggcggactggttaagcctggcggatctctgagactgtcttgtgccgccagcggcttcaccttcagcgattactacatgagctggatcagacaggcccctggcaaaggactggaatgggtgtcctacatcagcagcagcggctccaccatctactacgccgatagcgtgaagggcagattcaccatcagccgggacaacgccaagaacagcctgtacctccagatgaactccctgagagccgaggacaccgccgtgtactattgcgccagaggctacggcaaagcctacgatcaatggggccagggcacactggtcaccgtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2350 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggtcacacagccacctagcatgtctgccgctccaggccagcaagtgaccatctcttgtagcggcggcaacagcaacatcgagcggaactacgtgtcctggtatctgcaactgcctggcacagcccctaagctggtcatcttcgacaacgacagacggcccagcggcatccccgatagattttctggcagcaagagcggcaccagcgccacactgggaattaccggacttcagacaggcgacgaggccgactactactgtggcacatgggactctagcctgagaggctgggttttcggcggaggcacaaagctgacagtgcttggtggcggaggcggaagtggaggcggaggatctggcggcggaggctctgaagtgcagctcgttgagtctggcggcggactgattcaacctggcggaagcctgagactgagctgtgccgcttccggcttcaccttcagcaactacgccatgaactgggttcgacaggcccctggcaaaggactggaatgggtgtccaccatcaacggcagaggcagcagcaccatctacgccgattctgtgaagggcagattcaccatcagccgggacaacagcaagaacaccctgtacctccagatgaactccctgagagccgaggacaccgccacctattactgtgcccggtacatcagcagaggactgggcgattcttggggccagggcacactggttacagtgacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2351 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggtcacacagcctccatctgtgtctggcgctccaggccagagagtgaccatctcttgtaccggcagcagcagcaatatcggagccggctatgacgtgcactggtatcagcagctccctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggcagctatgtgtttggcaccggcaccaagctgacagtgcttggaggcggaggcggaagtggaggcggaggatctggcggcggaggctctgaagttcaactggtggaaaccggcggcaacctggttcaacctggcgcttctctgagactgagctgtgccgccagcggctttagctttagcggaacagccatgcactgggtccgacaggcacctggcaaaggactggaatgggtgtccaccatcagcagcacaggcagaagcacctactaccgggacagcgtgaagggcagattcaccatctccagagacaacagcaagaacaccctgtacctccagatgaacagcctgagaggcgaggacaccgccgtgtactattgtgccagagtgtccttcgactactggggccagggaaccctggtcacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2352 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggttacacagcctgcctccgtgtctggctctcctggccagagcatcaccatcagctgtaccggcaccagctctgatgtcggcggctacaattacgtgtcctggtatcagcagcaccccggcaaggcccctaagctgatgatctacgacgtgtccaagaggcccagcggcgtgtccaatagattcagcggcagcaagagcggcaacaccgccagcctgacaatttctggactgcaagccgaggacgaggccgactactactgtagcagctacaccagcagcagcacactggtgtttggcggaggcaccaagctgacagttcttggaggcggaggcggaagtggaggcggaggatctggcggcggaggctctgaagttcagctggttgaaagcggcggagcctttgttcagcctggcggatctctgagactgagctgtgccgccagcggcttcacattttccagctacgccatgacctgggtccgacaggctcctggcaaaggactggaatgggtgtccaccatctccggcagaggcagaagcaccttctacgccgatagcgtgaagggcagattcacaatcagccgggacaacagcaagaacaccctgtacctccagatgaacagcctgagagccgaggataccgccgtgtactactgtgcccggtactatcacgctggcgcctttgatctttggggccagggaacactggtcaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2353 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggacaacatcgagctgacccagagccccgccatcatgagtgcctctccaggcgagcgcgtgaccatgacatgtagcgccagcagcagcatccggtacatctactggtatcagcagaagcccggcagcagccccagactgctgatctacgacaccagcaacgtggcccctggcgtgccctttagattttccggcagcggctccggcaccagctacagcctgaccatcaaccggatggaagccgaggacgccgccacctactattgtcaggaatggagcggctacccctacaccttcggcggaggcaccaagctggacatcaagagaggcggaggcggaagtggaggcggaggatctggcggcggaggctctcaagtgaagctccaggaatctggcggcggactcgtgaagcctggcggctctctgaagctgagctgtgccgccagcggcttcaccttcagcagctacggcatgagctgggtgcgccagacccccgacaagagactggaatgggtggcaaccatcagcagcggcggcagctacacctactaccccgatagcgtgaagggccggttcaccatctccagagacaacgccaagaacaccctgtacctccagatgagcagcctgaagtccgaggataccgccatgtactactgcgccagaggcaactgggagggctggtacttcgatgtgtggggccagggcaccaccgtgaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2354 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggacaacttcatgctgacccagccccacagcgtgtccgagagccctggcaagaccgtgaccatctcctgtaccggcagcggcggcagcatcgacaacaactacgtgcactggtatcagcagaggcccggcagcgcccctaccaccgtgatgttcgaggacaaccagaggcccagcggcgtgcccgatagattcagcggctctatcgacagcagcagcaacagcgccagcctcgtgatctccggcctgaaaaccgaggacgagggcgactactactgccagagcagcgacggctccaaggtggtgtttggcggaggcaccaagctgaccgtgctgggacagggcggaggcggaagtggaggcggaggatctggcggcggaggctctgaagtgcaactggtgcagagcggcggaggctctctgacactgtcttgtgctgcctccggcgtggtgcagcctggcagattcaccttcagcagctacggaatgcactgggtgcgccaggcccctggaaagggactggaatgggtgtccgtgatctcttacgacggcagcaacaagtattacgccgacagcgtgaagggccggttcaccatctccagagacaacagcaagaacaccctgtacctccagatgaacagcctgcggaccgaggacaccgccgtgtactactgtgccaagaccctgtccgctggcgagtggattggaggcggagccttcgatatctggggccacggcacaatggtcaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2355 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagacccctctgagcctgcctgtgtccctgggcgatcaggccagcatcagctgtagaagcagccagagcctggtgcacagcaacggcaacacctacctgcactggtatctccagaagcccggccagagccccaagctgctgatctacaaggtgtccaacagattcagcggcgtgcccgacagattctccggcagcggctctggcaccgacttcaccctgaagatcagccgggtggaagccgaggacctgggcgtgtacttctgtagccagaacacccccgtgccccccaagtttggcagcggcaccaagctggaaatcaagggcggaggcggaagtggaggcggaggatctggcggcggaggctctcaggtgcagctccagcagtctggcgctgaactcgtgcggcctggcgcttctgtgaagctgtcttgcaaggccagcggctacaccttcaacgactacgagatgcactgggtcaagcagacccctgtgcacggcctgaagtggatcggagccctggaacccaagaccggcgataccgcctacagccagaagttcaagggcaaggccaccctgaccgccgacaagagcagcagcacagcctacatggaactgcggagcctgaccagcgaggacagcgccgtgtactactgcaccagctgctactactacacctacagcggccagggcaccctcgtgacagtgtctgctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2356 - DNA, 3294 bp, Artificial Sequence
  Synthetic Polynucleotide encoding a CAR with optional accessory module(s)
atggccttaccagtgaccgccttgctcctgccgctggccttgctgctccacgccgccaggccggacatccaactgacccagagccccagcagcctgtctgcctctgtgggcgacagagtgaccatcacctgtagagccagccagggcatcagaaacgacctgggctggtatcagcagaagcccggcaaggcccccaagcggctgatctatgctgccagctccctccagaatggcgtgcccagcagattttccggcagcggctctggcaccgagttcaccctgaccatcagctccctccagcccgaggacttcgccacctactactgcctccagcacaacacctaccccgccttcggccagggcaccaaggtggaaatcaagagaggcggaggcggaagtggaggcggaggatctggcggcggaggctctcaggtgcaactccaggaatctggccctggcctcgtgaagcctagccagaccctgagcctgacctgtaccgtgtctggcggcagcatcagcagcttcaactactactggtcctggatcagacaccaccctggcaagggcctggaatggatcggctacatctactacagcggcagcacctacagcaaccccagcctgaagtcccgcgtgaccatctccgtggacaccagcaagaaccagtttagcctgaccctgtccagcgtgacagccgccgataccgccgtgtactactgcgccagaggctacaactggaactacttcgactactggggccagggaaccctcgtgaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2357 - DNA, 3300 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgctgacccagagccccgccagcctggccgtgagcctgggccagagcgtgaccatcagctgcagagccagcgagagcgtggagtactacggcaccagcctgatgcagtggtaccagcagaagcccggccagccccccaagctgctgatctacgccaccagcaacgtggagagcggcgtgcccgccagattcagcggcagcggcagcggcaccgacttcagcctgaacatccaccccgtggaggaggacgacatcgccatgtacttctgccagcagagcagaaagctgcccagcaccttcggcggcggcaccaagctggagatcaagggcggaggcggaagtggaggcggaggatctggcggcggaggctctgacgtgagactgcaggagagcggccccggccaggtgaagcccagccagaccgtgagcctgacctgcagcgtgaccggctacagcatcaccaacggcaaccactggtggaactggatcagacaggtgagcggcagcaagctggagtggatcggctacatcagcagcagcggcagcaccgacagcaaccccagcctgaagagcagaatcagcatcaccagagacaccagcaagaaccagctgttcctgcagctgaacagcgtgaccaccgaggacatcgccacctactactgcgccagaggctactacttcgactactggggccagggcaccaccctgaccgtgagcagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2358 - DNA, 2934 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcaactggtggaaagcggcggaggcctggtgcaggctggcggatctctgagactgagctgtgccgccagcggcatcaccttcagcatcaacacaatgggctggtacagacaggcccctggcaagcagagggaactggtggccctgatctccagcatcggcgacacctactacgccgacagcgtgaagggccggttcaccatcagccgggacaacgccaagaacaccgtgtacctccagatgaacagcctgaagcccgaggacaccgccgtgtactactgcaagcggttcagaacagccgcccagggcaccgattattggggccagggaacacaagtgaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2359 - DNA, 2739 bp, Artificial Sequence
  Synthetic Polynucleotide encoding a CAR with optional accessory module(s)
atggactggatttggcgcatccttttccttgtcggcgctgctaccggcgcccattccttcgaaggcagcggattcgaatacgccaaagagatgcggaacgcctactgggagatcgccctgctgcccaatctgaccaaccagcagaagagagcccccatcagaaagctgtacgacgacccctcccagagcagcgagctgctgtctgaggctaaaaaactgaacgatagccagacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2360 - DNA, 2952 bp, Artificial Sequence
  Synthetic Polynucleotide encoding a CAR with optional accessory module(s)
atggccctgcccgtgacagccctgctgctgcctctggctctgctgctgcacgccgccagacccgatgaattcggctctgacctgggcatcaagctgctgttcgccgctgccaagggccaggacgacgaagtgcggattctgctggctgctggggccgacgtgaacgccaaggatttcgagggctacacccccctgcacgtggccgcctatgatggacacctggaaatcgtggaagtgctgctgaaggctggcgctgatgtgaatgccaaagacagccagggccggacccctctgcatgaagccgcctacagcggccatctggaaattgtggaagtgctgctgaaagccggggcagacgtgaacgctcaggacgacgctggcgagacaccagccgatctggctgcagcttggggccacgaagatatcgccgaggtgctgcagaagacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2361 - DNA, 2949 bp, Artificial Sequence
  Synthetic Polynucleotide encoding a CAR with optional accessory module(s)
atggactggatttggcgcatccttttccttgtcggcgctgctaccggcgcccattccttcgaaagaagcgatctgggaaagaagctgctggaagctgccagagccggacaggatgatgaagtgcgcatcctgatggcaaacggcgcagatgtgaacgcaaaggacgagtacggcctgacccccctgtacctggctacagcccacgggcacctggaaattgtggaagtgctgctgaagaacggcgctgacgtgaacgccgtggacgccatcggctttaccccactgcatctggccgctttcatcgggcatctcgaaatcgcagaggtgctgctgaaacacggggccgatgtgaatgcccaggacaagttcggcaagaccgccttcgacatcagcatcggcaacggcaacgaggacctggccgagatcctgcagaaactgaacacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2362 - DNA, 3405 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcaactggtggaaagcggcggaggcctggtgcaggctggcggatctctgagactgagctgtgccgccagcggcatcaccttcagcatcaacacaatgggctggtacagacaggcccctggcaagcagagggaactggtggccctgatctccagcatcggcgacacctactacgccgacagcgtgaagggccggttcaccatcagccgggacaacgccaagaacaccgtgtacctccagatgaacagcctgaagcccgaggacaccgccgtgtactactgcaagcggttcagaacagccgcccagggcaccgattattggggccagggaacacaagtgaccgtgtcctctctcgagggaggaggcggctccgggggaggcggaagtggaggcggaggatctgggtctggaggaagcggatctggaggctcagggtcagggggctcaggcagtggaggctctttcgaagtgcaactggtggaatctgggggcggactggtgcagccaggcggaagtctgaggctgtcttgtgccgcctccggcagcatcttcggcttcaacgacatggcctggtatcggcaggctcccggaaaacagcgcgagctggtggctctgattagcagagtgggcgtgaccagcagcgccgactctgtgaagggcagattcacaatctccagagtgaacgccaaggatacagtgtacctccagatgaactctctgaaacctgaggatacagcagtgtactattgctacatggaccagcggctggacggcagcacactggcctactggggacagggaactcaagtgacagtgtctagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2363 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccaggacgtgaacaccgccgtggcctggtatcagcagaagcctggcaaggcccccaagctgctgatctacagcgccagcttcctggaaagcggcgtgcccagcagattcagcggaagcagaagcggcaccgacttcaccctgaccatcagctccctccagcccgaggacttcgccacctactactgccagcagcactacaccacccctcccaccttcggccagaccaaggtggaaatcaagagaggcggaggcggaagtggaggcggaggatctggcggcggaggctctgaagtgcaactggtggaatctggcggcggactggtgcagcctggcggatctctgagactgagctgtgccgccagcggcttcaacatcaaggacacctacatccactgggtgcgccaggcccctggaaagggactggaatgggtggcccggatctaccccaccaacggctacaccagatacgccgacagcgtgaagggccggttcaccatcagcgccgacaccagcaagaataccgcctacctccagatgaacagcctgcgggccgaggataccgccgtgtactactgctcaagatggggaggcgacggcttctacgctatggacgtgtggggccagggcacccttgtgaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2364 - DNA, 2934 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgacgtgcaactcgtggaatccggcggaggcctggtgcagcctggcggatctctgagactgagctgtgccgccagcggctctatcggcggactgaatgccatggcctggtacagacaggcccctggcaaagaacgggaactggtggccggcatctttggcgtgggcagcaccagatacgccgacagcgtgaagggccggttcaccatcagccgggacaacagcaagaacaccgtgtacctgcagatgaacagcctgcggcccgaggataccgccgtgtactactgcagaatgtccagcgtgaccagaggctccagcgactactggggccagggaacacttgtgaccgtgtccagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2365 - DNA, 2754 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgtggacaacaagttcaacaaagagcggtacagcgcctactacgagatttggcaactgcccaacctgaacgtgcggcagaaggccgccttcatcggatctctgcaggacgaccctagccagagcgccaatctgctggccgaggccaagaagctgaacgacgcccaggcccctaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2366 - DNA, 3420 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgacgtgcaactcgtggaatccggcggaggcctggtgcagcctggcggatctctgagactgagctgtgccgccagcggctctatcggcggactgaatgccatggcctggtacagacaggcccctggcaaagaacgggaactggtggccggcatctttggcgtgggcagcaccagatacgccgacagcgtgaagggccggttcaccatcagccgggacaacagcaagaacaccgtgtacctgcagatgaacagcctgcggcccgaggataccgccgtgtactactgcagaatgtccagcgtgaccagaggctccagcgactactggggccagggaacacttgtgaccgtgtccagtctcgagggaggaggcggctccgggggaggcggaagtggaggcggaggatctgggtctggaggaagcggatctggaggctcagggtcagggggctcaggcagtggaggctctttcgaagtgcaactggtggaatctggaggctctctggtgcagccagggggaagcctgagactgtcttgtgccgcttccggcttcaccttcgacgactacgccatgagctgggtgcgccaggtgccaggcaaaggcctggaatgggtgtccagcatcaactggagcggcacccacaccgattacgccgactccgtgaaaggcagattcacaatcagcagaaacaacgccaacaataccctgtacctgcagatgaactccctgaagtctgaggatacagcagtgtattattgcgccaagaactggcgggacgccggcaccacttggtttgagaaaagcggctctgccggacagggaacccaagtgacagtgtcctccacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2367 - DNA, 3294 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtgctgacacagcctcctagcgtgtcagtggcccctggcaagaccgccagaatcccctgcgagggcaactacatcggcagcagcaacgtgcactggtatcagcagaagcccggccaggctcccgtgctcgtgatccacttcgacagcgacagacccagcggcatccccgacagattcagcggcagcaacagcggcaacatggctaccctgaccatcagcagagtggaagccggggacgaggccgactactactgtcaagtgtgggagaaccacggctgggtgttcggcggaggcaccaagctgacagtgctgtctggcggaggcggaagtggaggcggaggatctggcggcggaggctctgaggtgcaactggtggaaacaggcggcggactggtgcagcctggcgagtctctgagactgagctgtgccgccagcggcttcaccttcagcgactacgagatgaactgggtgcgccaggcccctggaaagggcctggaatgggtgtcctacatcagcagctccggcagcaccatctactacgccgacagcgtgaagggccggtttaccatctaccgggacaacgccaagaacagcctgtacctccagatgaactccctgcgggccgaggacaccgccctgtactattgtgccagagcctggggcgtgggaccccctgattattggggacagggcaccctcgtgaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2368 - DNA, 3318 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgataccgtgaccatcacctgtcaggccaacggctacctgaactggtatcagcagcggagaggcaaggcccccaagctgctgatctacgacggcagcaagctggaaagaggcgtgcccagcagattcagcggcagaagatggggccaggagtacaacctgaccatcaacaacctccagcccgaggatattgccacatacttttgccaggtgtacgagttcgtggtgcccggcacacggctggacctgaagagaacagtggctgctcctggcggaggcggaagtggaggcggaggatctggcggcggaggctctcaggtgcagctgctccagtctggcgctgccgtgacaaagcctggcgcttctgtgcgggtgtcctgtgaagccagcggctacaacatccgggactacttcatccactggtggcggcaggctccaggccagggactccagtgggtgggatggatcaaccccaagaccggccagcccaacaaccccagacagttccagggcagagtgtccctgaccagacacgccagctgggacttcgacaccttcagcttctacatggatctgaaggccctgcggagcgacgataccgccgtgtacttctgcgccagacagagaagcgactactgggatttcgacgtgtggggcagcggcacccaagtgacagtgtctagcgccagcaccaagggacccacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2369 - DNA, 3336 bp, Artificial Sequence
  Synthetic Polynucleotide encoding a CAR with optional accessory module(s)
atggccttaccagtgaccgccttgctcctgccgctggccttgctgctccacgccgccaggccgcagtctgccctgacacagcctcctagcgcctctggctctcccggccagagcatcaccatcagctgtaccggcaccagcaacaacttcgtgtcctggtatcagcagcacgccggcaaggcccccaagctcgtgatctacgacgtgaacaagcggcccagcggcgtgcccgatagattcagcggcagcaagagcggcaacaccgccagcctgacagtgtctggcctccagaccgatgacgaggccgtgtactactgcggcagcctcgtgggcaactgggacgtgatctttggcggaggcaccaagctgaccgtgctgggcggaggcggaagtggaggcggaggatctggcggcggaggctctcagccccagctccaggaatctggccccacactggtggaagccagcgagacactgagcctgacctgtgccgtgtccggcgattctaccgccgcctgcaatagcttctggggctgggtgcgccagcctcctggaaagggactggaatgggtgggaagcctgagccactgcgccagctattggaaccggggctggacctaccacaaccccagcctgaagtccagactgaccctggccctggacacccccaagaacctggtgttcctgaagctgaacagcgtgacagccgccgacaccgccacctactactgtgccagatttggcggcgaggtgctgcggtacaccgactggcctaaacctgcctgggtggacctgtggggcagaggaacactcgtgaccgtgtccagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2370 - DNA, 3291 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgagacagccatcatcagctgccggacaagccagtacggcagcctggcctggtatcagcagaggccaggacaggcccccagactcgtgatctacagcggcagcacaagagccgccggaatccccgatagattcagcggctccagatggggacccgactacaacctgaccatcagcaacctggaaagcggcgacttcggcgtgtactactgccagcagtacgagttcttcggccagggcaccaaggtgcaggtggacatcaaaagaggcggaggcggaagtggaggcggaggatctggcggcggaggctctcaggtgcagctggtgcagtctggcggccagatgaagaaacccggcgagagcatgagaatcagctgtcgggcctccggctacgagttcatcgactgcaccctgaactggatcagactggcccctggcaagcggcctgagtggatgggatggctgaagcctagaggcggagccgtgaactacgccagacctctccagggcagagtgaccatgaccagggacgtgtacagcgataccgccttcctggaactgcggagcctgaccgtggatgataccgccgtgtacttctgcaccagaggcaagaactgcgattacaactgggacttcgagcactggggcagaggcacccctgtgatcgtgtctagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2371 - DNA, 3321 bp, Artificial Sequence
  Synthetic Polynucleotide encoding a CAR with optional accessory module(s)
atggccttaccagtgaccgccttgctcctgccgctggccttgctgctccacgccgccaggccggagctggtgctgacacagagccctggcaccctgtctctgtctgccggcgaaagagccaccctgagctgtagagccagccagagcgtgtcctctggcagcctggcttggtatcagcagaagccaggccaggcccccagactgctgatctacggcgcttctaccagagccaccggcatccccgatagattcagcggctctggctccggcaccgacttcaccctgacaatcggcagactggaacccgaggacctggccgtgtactactgccagcagtacggcaccagcccctacacattcggccagggcaccaagctggaaatcggcggaggcggaagtggaggcggaggatctggcggcggaggctctctggaacagagcggagccgaagtgaagaaacccggcagcagcgtgcaggtgtcctgcaaagcaagcggcggcaccttctctatgtacggcttcaactgggtgcgccaggctcctggacacggcctggaatggatgggcggcatcatccccatcttcggcacctccaactacgcccagaaattccggggcagagtgaccttcaccgccgaccaggccacaagcaccgcctacatggaactgaccaacctgcggagcgacgacaccgccgtgtattattgcgccagagacttcggccccgactgggaggatggcgacagctacgatggcagcggcagaggcttcttcgacttctggggccagggaacccttgtgaccgtgtcctcaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2372 - DNA, 3309 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgacaatcacctgtcagagcagcctggacatcagccactacctgaactggtatcagcagaagcccggcaaggcccctaagctgctgatctacgacgccagcaatctggaaaccggcgtgcccagcagattttctggcagcggaagcggcacccacttcaccttcacaatatccagcctccagcctgaggacttcgccacctactactgccagcagtacgacaacctgcctctgacctttggcggaggcaccaagctggaaatcaagagaggcggaggcggaagtggaggcggaggatctggcggcggaggctctcaagttcaactggttcaatcaggcggaggcgtggtgcaacctggtggctctctgagagtgtcttgtgctgcctctggcgtgaccctgagcgactatggaatgcactgggtccgacaggcccctggcaaaggacttgagtgggtcgccttcatcagaaacgacggcagcgacaagtattacgccgacagcgtgaagggcagattcaccatcagccgggacaacagcgagaaaaccgtgtctctccagatgtctagcctgagagccgaggacaccgccgtgtactactgtgccaagaatggcgagagcggccctctggactactggtatctggatctgtggggcagaggcaccctggtcacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2373 - DNA, 3309 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgatgacccagagccaggacagcatggctaccagcgtgggcgagcgcgtgaccgtgaattgcaaggccagccagaacgtggacaccaacgtggcctggtatcagcagaagcccggccagtctcctgagcccctgctgttcagcgccagctacagatacaccggcgtgcccgacagattcagcggcagcggctctggcaccgacttcaccctgacaatcagcagcgtgcaggccgaggacgtggccgagtatttctgccagcagtacaacagctaccccctgaccttcggccagggcaccaagctggaaatcaagagaggcggaggcggaagtggaggcggaggatctggcggcggaggctctgaagtgcaggtggaagtgtctggcggcggactggtgcagcctggcggatctatgagactgagctgtgccgtgtccggcttcaccttcagcaactactggatgaactgggtgcgccagtcccccgagaagggcctggaatggatcgccgagatccggctgaagtccaacaacttcgcccggtactacgccgagagcgtgaagggcagattcaccatcagccgggacaacagcaagaacagcctgtacctccagatgatctccctgagagccgaggacaccgccatctactactgcaccagctacggcaactacgtgggccactacttcgaccactggggccagggaacactgctgaccgtgtctagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2374 - DNA, 3321 bp, Artificial Sequence
  Synthetic Polynucleotide encoding a CAR with optional accessory module(s)
atggccttaccagtgaccgccttgctcctgccgctggccttgctgctccacgccgccaggccgagctacgagctgacacagcctccatccgtgtctggcacacctggacagagagtggctatctcctgtagcggcagcagcagcaacatcggcaccagaatggtcacctggtatcagcacgtgccaggcacagcccctaagctgctgatcttcaacaacaaccagcggcctagcggcgtgcccgatagattttctgccagcaagagcggcacaagcgccagcctggctatcatcggactccagtctgacgacgaggccgactactactgtgccacctgggacgacaacgtgaagtcctacgtgttcggcaccggcaccaaagtgacagtgcttggaagtagaggcggaggcggaagtggaggcggaggatctggcggcggaggctctcttgaaatggcccaggttcagctccagcagtggggagctggactgctgaagcctagcgagacactgagcctgacctgtgctgtgtacggcggcagcttcagcggctactactggtcctggatcagacagcctcctggcaaaggactggaatggatcggcgagatcaaccacagcggctccaccaactacaaccccagcctgaagtccagagtgaccatcagcgtggacaccagcaagaaccagttctccctgaagctgagcagcgtgacagccgctgataccgccgtgtactattgcgctagagcccctcagtcttggtacgtgggagatgtgtggggccagggcacactggttacagtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2375 - DNA, 3312 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctcctagcctgtctgtggcccctggaaagacagccagcatcacatgcggcggcaacaacatcggcatgaagtccgtgcactggtatcagcagaggccaggacaggctcctgtgctggtcatctactacgacagcgacagaccctctggcatccccggcagattttccggcagcaactctggcaataccgccacactgaccatctccagagtggaagctggcgacgaggccgactactactgccaagtgtgggataccaccggcgatcaccctggctatgtgtttggcaccggcaccaaagtgacagtgcttggcggaggcggaagtggaggcggaggatctggcggcggaggctctcaagttcaactggttcagagcggagccgaagtgaagaaacctggcagcagcgtgaaggtgtcctgcaaagcaagcggcggcacctttagcagctacgccatctcttgggtccgacaggcacctggacaaggactggaatggatgggcggcatcatccccatcttcggcacagccaattacgcccagaaattccagggcagagtgaccatcaccgccgacgagtctacaagcaccgcctacatggaactgagcagcctgagaagcgaggacaccgccgtgtactattgtgccagaggcgtgtacggctacagcggctctgccccttatgatgagtggggccagggaaccctggtcaccgtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2376 - DNA, 3330 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacccagagccctctgagcctgcctgtgacacctggcgagcctgccagcatctcctgtagaagcagccagagcctgctgcacagcaacggctacaactacctggactggtatctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagaccccccggacctttggacagggcaccaaggtggaaatcaagcggggcggaggcggaagtggaggcggaggatctggcggcggaggctctcaggtgcaactggtgcagtctggcggcggagtggtgcagcctggaagaagcctgagactgagctgtgccgccagcggcttcaccttcagcagctacggaatgcactgggtgcgccaggcccctggcaaaggactggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgcgccagagacttcgactacggcgacagctactactactatggcatggacgtgtggggccagggcacaaccgtgaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2377 - DNA, 3312 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgggcagctacctggcctggtatcagcagaagcctggcgctccccggctgctgatctacgatgcctctcacagagccaccggcatccccgccagattttctggcagcggctccggcaccgacttcaccctgacaatcagctccctggaacccgaggacttcgccgtgtactactgccagcagcggagcaactggccccccatgtataccttcggccagggcaccaagctggaaatcaagagaggcggaggcggaagtggaggcggaggatctggcggcggaggctctgaagtgcagctggtgcagtctggcgctgaggtgtccgtgaaggtgtcctgcaaagccagcggcggcaagaagcccggcagcacctttagcagctacaccatcagctgggtgcgccaggcacctggacagggcctggaatggatgggcggcatcatccccatcttcggcaccgccaactacgcccagaaattccagggcagagtgaccatcaccgccgacaagagcaccagcaccgcctacatggaactgagcagcctgcggagcgaggacacagccgtgtattattgtgccggcgacaccgacagcagcggctactatggcgctgtggactattggggccagggaaccctcgtgaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2378 - DNA, 3261 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtcaggccagccaggacatcaacaactacctgaactggtatcagcagaagcccggcaaggcccccaagctgctgatctacgacgccagcaatctgcagaccggcgtgcccagcagattttccggctctggcagcggcaccgacttcaccttcaccatcgaggacattgccacctactactgccagcagtacaccttcggccctggcaccaaggtggacatcaaaggcggaggcggaagtggaggcggaggatctggcggcggaggctctgaagtgcaactgctggaatctggcggcggactggtgcagcctggcggatctctgagactgagctgtgccgccagcggcttcacctttagctggtacagcatgacctgggtgcgccaggcccctggcaaaggactggaatgggtgtccagcatcgtgccctggggcgatttcacccagtacgccgatagcgtgaagggccggttcaccatcagccgggacaacagcaagaacaccctgtacctgcagatgaacagcctgcgggccgaggacaccgccgtgtactattgtgccaagggacctggctggggcagcttcgatctgtggggcagaggaacccttgtgaccgtgtccagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2379 - DNA, 2928 bp, Artificial Sequence
  Synthetic Polynucleotide encoding a CAR with optional accessory module(s)
atggactggatttggcgcatccttttccttgtcggcgctgctaccggcgcccattccgaggttcagttggtcgaatcaggcgggggcctcgtccaacccggcggaagcctgcggctgtcttgcgcagcaagtggtagtgtgttcaagatcaacgttatggcctggtatcgccaggctccgggaaaagggagagagctggttgcggggatcattagcggtggctccaccagctacgctgacagtgtgaagggaaggttcactatatcacgcgacaacgcaaagaatacattgtacctccagatgaatagcttgcggcccgaagacacggcagtctactattgtgcctttatcacaacagagagcgactatgacctgggccgccggtattgggggcagggaacccttgtgaccgtttcatccacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2380 - DNA, 3291 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtaccgccagcctgagcgtgtccagcacctacctgcactggtatcagcagaagcccggcagcagccccaagctgtggatctacagcaccagcaacctggcctccggcgtgcccagcagattttctggcagcggctctggcaccagctacaccctgaccatcagctccctccagcccgaggacttcgccacctactactgccaccagtaccacagaagccccctgacctttggcggaggcaccaaggtggaaatcaagagaggcggaggcggaagtggaggcggaggatctggcggcggaggctctgaagtgcaactggtggaatctggcggcggactggtgcagcctggcggatctctgagactgagctgtgccgccagcggcttcagcctgaccaaatacggcgtgcactgggtgcgccaggcccctggaaaaggactggaatgggtgggagtgaagtgggctggcggctccaccgactacaacagcgccctgatgagccggttcaccatcagcaaggacaacgccaagaacagcctgtacctccagatgaactccctgcgggccgaggacaccgccgtgtactactgtgccagagatcaccgggacgctatggactactggggccagggaacactcgtgaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2381 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgggaacagccgtggcctggtatcagcagaagcctggcaaggcccccaagctgctgatctacagcgccagctacagatccaccggcgtgcccagcagattttccggctctggcagcggcaccgacttcaccctgaccatctctagcctccagcccgaggacttcgccacctactactgccagcaccactactccgccccctggacatttggcggaggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagaaacggcatgagctgggtgcgccaggcccctggaaaaggactggaatgggtggcaaccgtgtccagcggcggcagctacatctactacgccgacagcgtgaagggccggttcaccatctccagagacaacgccaagaacagcctgtacctccagatgaactccctgcgggccgaggacaccgccgtgtactattgtgccagacagggcaccaccgccctggctaccagattcttcgatgtgtggggccagggcaccctcgtgaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2382 - DNA, 3321 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccagcagcctgaccatgagcgtgggccagaaagtgaccatgtcctgcaagagcagccacagcctgctgaacagccggaaccagaagaactacctggcctggttccagcagaagcccggccagtcccccaagctgctggtgtacttcgcaagcacccgcgagagcggcgtgcccgacagattcatcggcagcggctccggcaccgacttcaccctgaccatcagcaacgtgcaggccgaggacctggccgactacttctgccagcagcactacaccaccctgcccaccttcggcggaggcaccaagctggaaatcaagggcggaggcggaagtggaggcggaggatctggcggcggaggctctcagatccagctggtgcagagcggccctgacctgaagaaacccggcgagacagtgaagatcagttgcaaggcctccggctacaccttcaccaacacaggcatgaactgggtcaagcaggcccctggcaagggcctgaagtggatgggctggatcaacacctacaccggcgagcccacctacgccgacgacttcaagggccggttcaccttcagcctggaaaccagcgccagcaccgcctacctgcagatcaacaacctgaagaacgaggacaccgccacctatttctgcaccagatggggctacggcagcagcctgtactacgccatggactactggggccagggcaccagcgtgaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2383 - DNA, 3291 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagcccccctagcctgtctgcctctgtgggcggcaaagtgaccatcacatgcaaggccagccaggacatcgaccgctacatggcctggtatcaggacaagcccggcaagggacccaagctgctgatccacgataccagcaccctccagcccggcatccccagcagattttctggcagcggctccggcagagactacagcttcagcatcagcaacctggaacccgaggacattgccacctactactgcctccagtacgacaacctgtggaccttcggcggaggcaccaagctggaaatcaagagaggcggaggcggaagtggaggcggaggatctggcggcggaggctctcaggtgcaactggtgcagagcggagccgagcttgtgaagcctggcgcttccgtgaagatgagctgcaaagccagcggctacatcttcaccaactacaacatccactgggtcaagaagtccccaggccagggcctggaatggatcggagccatctaccccggaaacggcgacgccccttacagccagaagttccaggacagagccaccctgaccgccgacaccagcagcagcaccacctacatggaactgagcagcctgaccagcgaggacagcgccgtgtactattgcgtgcgggccaactgggatgtggccttcgcctattggggccagggcacactggtgtccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2384 - DNA, 3294 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccctgccagcctgtctgcctctgtgggcgagacagtgaccatcacctgtcgggtgtccggcaacatccacaactacctggcctggtatcagcagaagcagggcaagagcccccaactgctggtgtacaacgccaagaccctggccgatggcgtgcccagcagattttctggctctggcagcggcacccagtacagcctgaagatcaacagcctccagcccgaggacttcggcagctactactgccagcacttctggtccaacccctacaccttcggcggaggcaccaagctggaaatcaagggcggaggcggaagtggaggcggaggatctggcggcggaggctctcaggtgcaactccagcagtctggcgcttccgtgaaggtgtcctgcaaggccagcgaactcgtgcggcctggcacaggctacgccttcaccaattacctgatcgagtgggtcaagcagaggcccggacagggcctggaatggatcggagtgattaacccaggcagcggcggcaccaactacaacgagaagttcaagggcaaggccaccctgaccgccgacaagagcagcagcacagcctacatgcaactgagcagcctgaccagcgacgacagcgccgtgtacttctgcgcccggtacagaagctacgactggtacttcgacgtgtggggagccggcaccaccgtgacagtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2385 - DNA, 3309 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcagcctgtctgccagcgtgggcgacagagtgaccatcacctgtcggagcagccagcggatcgtgcacagcaacggcaacacctacctggaatggtatcagcagacccccggcaaggcccccaagctgctgatctacaaggtgtccaacagattcagcggcgtgcccagcaggtttagcggctctggcagcggcaccgactacacccctaccatctctagcctccagcccgaggacattgccacctactactgttttcaaggcagccacgtgccccccaccttcggccagggaacaaagctccagatcaccggcggaggcggaagtggaggcggaggatctggcggcggaggctctgaggtgcaactggtggaatctggcggcggagtggtgcagcctggcagaagcctgagactgagctgtagcagcagcggccctaccttcagcgactactacatgtactgggtgcgccaggcccctggcaagggactggaatgggtggcctacatgagcaacgtgggagccatcaccgattaccccgacaccgtgaagggcagacccaccatcagccgggacaacagcaagaataccctgttcctgatggacagcctgcggcccgaggataccggcgtgtacttttgcgccagaggcaccagggacggcagttggttcgcctattggggccagggcacacccgtgaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2386 - DNA, 3291 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagcttcagcagcctgagcgccagcgtgggcgacagagtgaccatcacctgtagagccagccaggacatcagcaactacctgaactggtatcagcagaagcccggcaaggcccccaagctgctgatctactacaccagcagactgcacagcggcgtgcccagcagattttctggcagcggctccggcaccgactacaccctgacaatcagctccctgcagcccgaggacttcgctacctacttctgtcagcaaggcaacaccctgccctggacctttggcggaggcaccaagctggaaatcaagagaggcggaggcggaagtggaggcggaggatctggcggcggaggctctgaagtgcaactggtgcagtccggcggagggctggtgcagagcggaggatctctgagactgagctgcagagccagcggctacaccttcacccggtactggatgctgtgggtgcgccagaggccaggcaagggactggaatgggtggccgagatcaacccccggaacgaccggaccaactacaacgagaagttcaagacccggttcaccatcagcgtggacagaagcaagaacaccctgtacctgcagatggacagcctgcgggccgaggataccgccgtgtacttttgtgctctgggaggcggctacgctatggactactggggccagggaacccttgtgaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2387 - DNA, 3252 bp, Artificial Sequence
  Synthetic Polynucleotide encoding a CAR with optional accessory module(s)
atggaaatgctccagggcctgctgctgctcctgctgctttctatgggcggagcttgggccagcagagagcctcttagaccttggtgtcaccccatcaacgccatcctggccgtggaaaaagagggctgccctgtctgcatcaccgtgaacaccacaatctgcgccggctactgccccaccatgatgagagtgctgcaagccgttctgcctcctctgcctcaggtcgtgtgcacctatcgggacgtccgcttcgagagcatcagactgcctggatgtcctagaggcgtggaccccgtggtgtcttttcctgtggctctgtcctgtagatgcggcccctgtagaagaagcaccagcgattgcggcggacccaaggatcaccctctgacatgcgatcacccacagctgagcggcctgttgtttcttggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2388 - DNA, 3294 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagtctccggcgtcactgtccgcctccgtgggggagactgtgactattatttgtagggcatcagttaacatctactcttatttggcctggtaccagcagaagcaaggcaagagtcctcagctgctggtgtataatgcgaagatcctggcagagggcgtgccgagccggttctccggcagcggctcaggtacccaattttccctcaagatcaattcactgcagccagaggactttggcagttactattgtcaacaccactacggcacattcactttcgggtccggtacaaaattggagattaagcgaggcggaggcggaagtggaggcggaggatctggcggcggaggctctcaggtacagttgaaagaaagcgggcctggactggtagcgccttcccaatctctctccatcacgtgcaccatctctggcttctccctgacttcctatggagttcactgggtgaggcagccccccggcaagggactggaatggctggtcgtcatctggtccgacgggtccacaacctacaactccgctctgaaaagtcggctctctatttctaaagataatagcaagagccaggtgtttctgaaaatgaactctctgcagaccgatgatacggccatttactactgcgcttcacactatggctcaaccttggcattcgcttcctggggccacggaacactggtgaccgtttccgcagccacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2389 - DNA, 3318 bp, Artificial Sequence
  Synthetic Polynucleotide encoding a CAR with optional accessory module(s)
atggccttaccagtgaccgccttgctcctgccgctggccttgctgctccacgccgccaggccggacattgtgatgacccagtctcacaaattcatgtccacatcagtaggagacagggtcagcgtcacctgcaaggccagtcagaatgtgggtaataatgtagcctggtatcaacagaaaccagggcaatctcctaaagtactgatttactcggcatcctaccggtacagtggagtccctgatcgcttcacaggcagtggatctgggacagatttcactctcaccatcagtaatgtgcagtctgaagacttggcagagtatttctgtcagcaatataacacctatccattcacgttcggctcggggacaaagttggaaataaaaggcggaggcggaagtggaggcggaggatctggcggcggaggctctgaggtacagctggaggaaagcggtggaggactggtgcaacctggagggtctatgaagctctcttgcgtagcttctgggttcacgttctccaattactggatgaactgggtgcggcagtcccccgagaaaggcctggaatgggtagcagaaattcggttcaagtcccataactatgctacacactttgccgagtctgtcaaaggccggttcactattagtcgagacgacagcaagtcttcagtctacctgcagatgaataacttgcgggcagaggacacaggtatctactactgcaccaggagaatcggcaactccgactatgactggtggtactttgacgtctggggagcaggcaccagcgtgacggtgagttcagcctcaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2390 - DNA, 3306 bp, Artificial Sequence; identical to SEQ ID NO: 2275
  Synthetic Polynucleotide encoding a CAR with optional accessory module(s)

SEQ ID NO: 2391 - DNA, 3324 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtgctgacacagcctccatccgtgtctggcgctccaggccagagagtgaccatctcctgtaccggcagcagcagcaacatcggagccggctatgacgtgcactggtatcagcaactgcccggcaccgcccccaagctgctgatctacggcaacagcaacagacccagcggcgtgcccgatagattcagcggcagcaagagcggcacaagcgccagcctggctatcactggactccaggccgaggacgaggccgactactactgccagagctacgacaacagcctgtcctcctgggtgttcggcggaggcaccaagctgacagtgctgggccagcctaagggcggaggcggaagtggaggcggaggatctggcggcggaggctctgaagtgcaactccagcagagcggagccgaagtgaagaaacccggcagctccgtgaaggtgtcctgcaaggcttccggcggcaccttcagcagctacgccatttcttgggtgcgccaggcccctggacagggcctggaatggatgggcagaatcatccccatcctgggaatcgccaactacgcccagaaattccagggccgcgtgaccatcaccgccgacaagagcacaagcaccgcctacatggaactgagcagcctgcggagcgaggacaccgccgtgtactactgcgccagagatgtgggcagcggctcctacagcctggactattggggccagggcaccctcgtgaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2392 - DNA, 3315 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtcgtgacacagcctccatctgtgtctgccgcccctggccggaaagtgaccatctcttgtagcggcagcagcagcaacatcggcagcaactacgtgtcctggtatcagcaggtgcccggcaccgcccctaagctgctgatctacgaggacgacaagcggcccagcggcatccccgatagattcagcggctctaagagcggcaccagcgccacactgggcatcaccggactccagacaggcgacgaggccgactacttctgcgccacctgggacagaaccgtgaacgtggtgcgctttggcggcggaaccagactgacagtgcacagccagcctaagggcggaggcggaagtggaggcggaggatctggcggcggaggctctcaactccaactccaggaaagcggccctggcctcgtgaagcctagcgagacactgagcctgacctgcaccgtgtctggcggcagcatctccagcagctcctactactggggctggatcagacagccccctggcaagggcctggaatggatcggctccatctactacagcggaagcacctactacaaccccagcctgaagtcccgcgtgaccatcagcgtggacaccagcaagaaccagttctccctgaagctgagcagcgtgacagccgccgataccgccgtgtactactgtgccagacatgtgggccacgagctggattactggggccagggcacactcgtgaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2393 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgccagctctctgcagtctggcgtgccatctggctttagcggcagcggctctggcaccgacttcaccctgaccatcagctccctgcagcccgaggacttcgccacctactactgccagcagagctacagcacccccctgacctttggcggaggcaccaaggtggaaatcaagagaggcggcggaggctcaggcggaggcggatctggcgggggaggatctcaggtgcaactgcaggaatctggccctggcctcgtgaagcccagcgagacactgagcctgacctgtaccgtgtctggcggctctgtgtccagcggcagctactactggtcctggatcagacagccccctggcaagggcctggaatggatcggctacatctactacagcggctccaccaactacaaccccagcctgaagtcccgcgtgaccatctccgtggacaccagcaagaaccagttctccctgaagctgagcagcgtgacagccgccgataccgccgtgtactactgtgccagagagggcaagaacggggccttcgacatctggggccagggcacaatggtcaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2394 - DNA, 2955 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgatgttcagttggtggagtctggtggcggtttggtgcagccaggtggctccctgcgactcagttgtgcagcctccgggttcattctggattactacgctattggttggtttcgacaggcccccggaaaggagagagagggcgtgctctgcattgatgccagcgacgacattacctactacgccgattctgtgaagggccgcttcaccatcagtagagacaatagcaagaatacagtctacctgcagatgaactccctgcgcccagaagacactgccgtctactactgtgctacccctatcgggctttcttcctcttgccttctcgaatatgactacgattactgggggcaggggacgctggtcaccgtgtctagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2395 - DNA, 3444 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgatgttcagttggtggagtctggtggcggtttggtgcagccaggtggctccctgcgactcagttgtgcagcctccgggttcattctggattactacgctattggttggtttcgacaggcccccggaaaggagagagagggcgtgctctgcattgatgccagcgacgacattacctactacgccgattctgtgaagggccgcttcaccatcagtagagacaatagcaagaatacagtctacctgcagatgaactccctgcgcccagaagacactgccgtctactactgtgctacccctatcgggctttcttcctcttgccttctcgaatatgactacgattactgggggcaggggacgctggtcaccgtgtctagcctcgagggaggtagcggctccgggggaggcggaagtggaggcggaggatctgggtctggaggaagcggatctggaggctcagggtcagggggctcaggcagtggaggctctttcgaagtgcaactggtggagtccggcggtggactggtacagcctgggggttcactgcgcctgtcctgcgccgccagcggaagaacctattacctcaatgctatgggttggttccgccaggccccaggaaaggagcgcgagttcgtggcggctattgactggtccgaggggaacaaggactatgctgattccgtgaagggcaggtttaccatcagccgggataattcaaaaaatactgtttatttgcagatgaactctcttagaccagaagacactgctgtctattactgcgccgctgacacccctccttggggaccactgatttatatcgaaagctatgattcctgggggcagggcacactcgtcaccgtgagtagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2396 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggaccagatcgtgctgacccagtcccccgctattatgtccgcatcaccgggcgaaaaagtgacgatctcctgtagcgcttcatctagcgtctcctacatgtattggtatcaacagaaacctgggtctagcccaaagccgtggatctacagaaccagtaaccttgccagtggggtgccagcccgcttcagcggtagtggcagtggaacttcctatagcctcacaataagcaacatggaggctgaagatgccgctgcctattactgccagcagtaccacagttacccaaccacgttcggcgggggaactaagctcgaagtaaaaggcggaggcggaagtggaggcggaggatctggcggcggaggctctgaggtgcagctggtggaatctgggggcggcctggtccaacctaagggatcactcaagctctcttgtgcggccagcggattctctttcaatacctatgctatgaattgggtgagacaggcgcccggaaagggcctcgaatggatagcccatatccggtcaaaatcaaacaatttcgcaacctactatgcggactccgtgaaggaccgattttccatctcccgagatgcctccgagaatattctgttcctgcagatgaataacctcaagacagaggacaccgccatgtactactgtgtgcgccagggcggtgactttcccatggattactgggggcaggggaccagcgtgaccgtgagctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2397 - DNA, 3294 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagcagcagcagcttcagcgtgagcctgggcgacagagtgaccatcacctgcatggccagcgaggacatctacatcagactggcctggtaccagcagaagcccggcaacgcccccagactgctgatcagcgccgccaccagcctggagaccggcgtgcccagcagattcagcggcagcggcagcggcaaggactacaccctgagcatcaccagcctgcagaccgaggacgtgggcacctactactgccagcagtactggagcagcccctggaccttcggcggcggcaccaagctggagatcaacggcggaggcggaagtggaggcggaggatctggcggcggaggctctgacgtgcagctgcaggagagcggccccggcctggtgaagcccagccagagcctgagcctgacctgcaccgtgaccggctacagcatcaccagcgactacacctggaactggatcagacagttccccggcaacaagctggagtggatgggctacatcacctacagcggcagcaccagctacaaccccagcctgaagagcagaaacagcatcaccagagacaccagcaagaaccagttcttcctgcagctgaacagcgtgaccaccgaggacaccgccacctactactgcgccagactgggcagaagatacacaatggactactggggccagggcaccagcgtgaccgtgagcagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2398 - DNA, 3291 bp, Artificial Sequence
  Synthetic Polynucleotide encoding a CAR with optional accessory module(s)
atggccctgcctgtgacagctctgctgctgcctctggcactgctgctgcacgccgccagacctgatgtgcagctccaggaaagcggccctggcctcgtgaagcctagccagagcctgagcctgacatgcaccgtgaccggctacagcatcaccagcgactacacctggaactggatcagacagttccccggcaacaagctggaatggatgggctacatcacctacagcggcagcaccagctacaaccccagcctgaagtcccggaactccatcaccagagacaccagcaagaaccagttcttcttgcagctgaacagcgtgaccaccgaggacaccgccacctactactgcgccagactgggcagacggtacaccatggactattggggccagggcacctccgtgaccgtgtctagcggaggcggaggaagtggcggcggaggatctgggggaggcggaagcgatatccagatgacccagtccagcagcagcttcagcgtgtccctgggcgacagagtgaccatcacctgtatggcctccgaggacatctacatccggctggcctggtatcagcagaagcccggcaacgcccccagactgctgattagcgccgccacctctctggaaaccggcgtgccaagcagattcagcggctctggcagcggcaaggactacaccctgagcatcacctccttgcagaccgaggacgtgggcacctactattgccagcagtattggagcagcccctggacctttggcggaggcacaaagctggaaatcaacacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2399 - DNA, 3294 bp, Artificial Sequence
  Synthetic Polynucleotide encoding a CAR with optional accessory module(s)
atggccctgcctgtgacagctctgctgctgcctctggcactgctgctgcacgccgccagacctgacatccagatgacccagagcagcagcagcttcagcgtgtccctgggcgacagagtgaccatcacatgcaaggccagcgaggacatctacatccggctggcctggtatcagcagaagcccggcaacgcccccagactgctgattagcgccgccacctctctggaaaccggcatccccagcagattctccggctctggcagcggcgaggactacaccctgacaatcaccagcctccagaccgaggacgtggcaacctactactgccagcagtattggaccaccccctggacctttggcggaggcaccaagctggaaatcaagagaggcggaggcggaagtggaggcggaggatctggcggcggaggctctgatgtgcagctccaggaatctggccccggactcgtgaagcctagccagagcctgagcctgacatgcaccgtgaccggctacagcatcaccatcgactacacctggaactggatcagacagttccccggcaacaaactggaatggatgggctacatcacctacagcggcagcaccgactacaaccccagcctgaagtccagaagctccatcaccagagacacctctatgaaccagttcttcttgcagctgaacagcgtgaccaccgaggacaccgccacctactattgcgccagactgggcagaagatacgccctggactattggggccagggcaccagcgtgacagtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2400 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggacatcgtaatgacccaggctgccccatccataccagtcactcccggtgaatccgtgtctatatcttgtaggtccgataagagtctgcttcacagcaacggcaatacttatcttttctggtttttgcagcgaccgggacaaagcccacaactgctgatctatagaatgtcaaatcttgcatcaggggtcccagatcgctttagtggatctgggtcaggcacagctttcaccctgagaatctccggagtggaagcagaagacgtaggcgtgtattactgtatgcagcaccttgagtatccttatacctttggaggcggaactaagctcgaaattaaaggcggaggcggaagtggaggcggaggatctggcggcggaggctctcaggttcaactgcagcagtctggacctgaactggtgaagcctggggcctcagtgaagatgtcctgcaaggcttctggctacgcattcagtagttcctggttgaactgggtgaggcagaggcctggaaagggtcttgagtggattggacggatttatcctggagatggagaaaatcactataatgggaaattcaagggcaaggccacactgactgcagacaaatcctccagcacaggctacatgcaactcagcagcctgacgtctgaggactctgcggtctacttctgtgcaagttattatgaagggggttattggggccaagggactctaatcactgtctctgcaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2401 - DNA, 3294 bp, Artificial Sequence
  Synthetic Polynucleotide encoding a CAR with optional accessory module(s)
atggccttaccagtgaccgccttgctcctgccgctggccttgctgctccacgccgccaggccggacatcgtactgacacagagccccgcttctctggcagtgtcactgggccagtccgttacaatatcctgtcgggcgagtgaatccgtggaatactatggaacaagtctcatgcagtggtatcagcagaaacctggacagccccccaagctgctcatctacggtgcgtcaaatgtcgagagtggggttccggcccgattcagtggttccgggagtggcacagactttagcctcaacatccatcctgttgaggaagacgatattgccatgtatttttgccaacagtcccgcaaagtcccctggacctttggtggaggaactaagctggagatcaagggcggaggcggaagtggaggcggaggatctggcggcggaggctctgaggtcaagctggtagagagtggaggtgggctggttaaaccaggggggagcagaaaactgagttgtgccgcaagtggcttcaccttttctagctataccatgagctgggtaagacaaactccagcaaagcgccttgagtgggtcgcaacaattagcagcggatcttctactatttattacgctgacactgttaagggccggtttaccatatcaagagacaacgccaagaatacccttttccttcaaatgacttcactgcggtccgaggatacggcaatgtactattgtgcacgacggtggtttctcgactgctggggccaggggactacccttaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2402 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccggaccaggtgcagctgcagcagtcgggcccaggactggtgaagccttcggagaccctgtccctcacctgcactgtctctggtgactccatcagtagttactactggagctggatcaggcagcccccagggaagggactggagtggattgggtatatctattacagtgggagcaccaactacaacccctccctcaagagtcgagtcaccatatcagtagacacgtccaagagccagttctccctgaagctgagctctgtgaccgccgcagacacggccgtgtattactgtgcgcgcggcaggtacttcgatgtctggggacgaggcactatggtgactagcagcggcggaggcggaagtggaggcggaggatctggcggcggaggctcttcctcctacgtgctgactcagcctccctccgtgtctgggtctcctggacagtcgatcaccatctcctgcactggaaccagcagtgacgttggtggttataactatgtctcctggtaccaacaacacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgcagctcatatacaaccaggagcacccgagttttcggcggagggaccaagctgaccgtcctaggtgccgccgcaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2403 - DNA, 3306 bp, Artificial Sequence
  Synthetic Polynucleotide encoding a CAR with optional accessory module(s)
atggccttaccagtgaccgccttgctcctgccgctggccttgctgctccacgccgccaggccggacatcgtaatgacacagtctcccctgtccctccctgtcacaccaggtgaacctgccagtatttcttgtagatccagtaagtcacttctgcactccaatgggaacacctacctgtattggttccagcaaaagcctggtcaggcacctcgcttgcttatttataggatgtccaatcttgcatccggcgtgccagaccgattctcaggctccggctctggtactgcatttaccctgaaaatctcccgcgtggaagcagaagatgtgggcgtgtactactgtatgcagcacatcgagtaccccttcacgtttggtcaaggcacaaagctggaaatcaaaggcggaggcggaagtggaggcggaggatctggcggcggaggctctcaggtccagctcgtccagtctggacccgaagtcaagaagccaggcgcctctgtgaaggtttcttgtaaggccagcggatatacattcactaattcatggatgaactgggtgaggcagcgccctggcaaggggcttgagtggatcgggcggatttacccaggggatggcgagacaatttacaacgggaaatttcgggtgagagtgacgatcaccgcagacgaatctacaagcacggcctacatggagttgtcctctctcaggagtgaggacaccgccgtctactattgtgctagaggttatgacgactattcattcgcatactggggccagggcaccaccgtcacagtatcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2404 - DNA, 3306 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgatgacccagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccaccagtacggcagcagcccccagacctttggacagggcaccaaggtggaaatcaagcggggcggaggcggaagtggaggcggaggatctggcggcggaggctctgaagtgcagctggtgcagtctggggccgaagtgaagaaacccggcagctccgtgaaggtgtcctgcaaggcttccggcggcaccttcagcagctacgccatttcttgggtgcgccaggcccctggacagggactggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccgtgcactacggcgactacgtgttcagcagcatggacgtgtggggccagggcacaaccgtgaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2405 - DNA, 3315 bp, Artificial Sequence
  Synthetic Polynucleotide encoding a CAR with optional accessory module(s)
atggccttaccagtgaccgccttgctcctgccgctggccttgctgctccacgccgccaggccggacgagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagccccagaacattcggccagggcaccaaggtggaaatcaagagaggcggaggcggaagtggaggcggaggatctggcggcggaggctctgaagtgcaactggtgcagagcggagccgaagtgaagaaacccggcagctccgtgaaggtgtcctgcaaggcttccggcggcaccttcagcagctacgccatttcttgggtgcgccaggcccctggacagggcctggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccagaggccccgagtattgcatcaacggcgtgtgcagcctggacgtgtggggccagggaacaaccgtgaccgtgtctagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2406 - DNA, 3321 bp, Artificial Sequence
  Synthetic Polynucleotide encoding a CAR with optional accessory module(s)
atggccttaccagtgaccgccttgctcctgccgctggccttgctgctccacgccgccaggccggacatcgagctgacccagagccctagcagcctggctgtgtctgccggcgagaaagtgaccatgagctgcaagagcagccagagcctgctgaacagccggacccggaagaatcaactggcctggtatcagcagaagcccggccagtctcccgagctgctgatctactgggccagcaccagacagagcggcgtgcccgatagattcacaggcagcggctccggcaccgacttcaccctgacaatcagcagcgtgcaggccgaggacctggccgtgtactactgccagcagagctacaacctgctgaccttcggccctggcaccaagctggaagtgaagagaggcggaggcggaagtggaggcggaggatctggcggcggaggctctgtgaagctgcaggaatctggcggcggattcgtgaagcctggcggctctctgaaggtgtcctgtgccgccagcggcttcaccttcagcagctacgccatgtcctgggtgcgcctgagccccgagatgagactggaatgggtggcaaccatcagctccgcaggcggctacatcttctacagcgactccgtgcagggccggttcaccatctccagagacaacgccaagaacaccctgcatctgcagatgggcagcctgagaagcggcgacaccgccatgtactattgcgccagacagggcttcggcaactacggcgactactacgctatggactactggggccagggaaccaccgtgaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2407 - DNA, 3318 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtcggagcagccagaacatcgtgcacagcaacggcaacacctacctggactggtatcagcagacccccggcaaggcccccaagctgctgatctacaaggtgtccaacagattcagcggcgtgcccagcaggtttagcggctctggcagcggcaccgacttcaccttcaccatcagctccctccagcccgaggacattgccacctactactgcttccagtacagccacgtgccctggaccttcggccagggcacaaagctccagatcggcggaggcggaagtggaggcggaggatctggcggcggaggctctcaggtgcagctccagcagtctggggccgaagtgaagaaacccggcagcagcgtgaaggtgtcctgcaaggccagcggctacacctttaccaactactacatctactgggtgcgccaggccccaggccagggactggaatggatcggcggcatcaatcctaccagcggcggcagcaacttcaacgagaagttcaagacccgcgtgacaatcaccgccgacgagagcagcaccaccgcctacatggaactgagcagcctgcggagcgaggataccgccttctacttctgcacccggcagggcctgtggttcgactctgatggcagaggcttcgacttctggggccagggaaccaccgtgaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2408 - DNA, 3006 bp, Artificial Sequence
  Synthetic Polynucleotide encoding a CAR with optional accessory module(s)
atggccttaccagtgaccgccttgctcctgccgctggccttgctgctccacgccgccaggccgctgttcaaccaggaagtgcagatccccctgaccgagagctactgcggcccctgccccaagaactggatctgctacaagaacaactgctaccagttcttcgacgagagcaagaattggtacgagagccaggcttcctgcatgagccagaacgccagcctgctgaaggtgtacagcaaagaggaccaggatctgctgaagctggtcaagagctaccactggatgggcctggtgcacatccccaccaacggctcttggcagtgggaggacggcagcatcctgagccccaacctgctgaccatcatcgagatgcagaagggcgactgcgccctgtacgccagcagcttcaagggctacatcgagaactgctccacccccaacacctacatctgtatgcagcggaccgtgggcggaggcggaagtggaggcggaggagacacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2409 - DNA, 3288 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctggacctttggacagggcaccaaggtggaaatcaagagaggcggaggcggaagtggaggcggaggatctggcggcggaggctctcaagtgcatctccaggaaagcggacccggcctcgtgaagcctagcgagacactgagcctgacctgcaccgtgtccgacgacagcatcagcagctactactggtcctggatcagacagccccctggcaagggcctggaatggatcggccacatcagctacagcggcagcgccaactacaaccccagcctgaagtccagagtgaccatctccgtggacaccagcaagaaccagttctccctgaagctgagcagcgtgacagccgccgacaccgccgtgtattattgcgccaactgggacgacgccttcaacatctggggccagggcacaatggtcaccgtgtctagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2410 - DNA, 3294 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagacccctctgaccctgagcgtgaccattggacagcccgccagcatctcctgcaagagcagccagagcctgctggacagcgacggcaagacctatctccactggctgttgcaacggccaggtcagagccccaagagactgatcttcctggtgtccaagctggactccggcgtgcccgatagattcacaggcagcggctccggcaccgacttcaccctgaagatcagccgggtggaagccgaggacctgggcgtgtactactgttggcagggcacccacttcccccagacctttggcggcggaacaaagctggaaatcaagggcggaggcggaagtggaggcggaggatctggcggcggaggctctgtgcaactccaagagtccggccctgacctcgtgaagcctagccagtctctgagcctgacctgcaccgtgaccggctacagcatcaccagcggctactcttggcactggatcagacagttccccggcaacaagctggaatggatgggctacatccactacagcggcgacaccgactacaaccccagcctgaagtcccggttctccatcaccagagacaccagcaagaaccagttcttcttgcaactgaactccgtgaccaccgaggacaccgccacctactactgtgccacccctggcggctttgtgtactggggccagggaacactcgtgaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2411 - DNA, 3306 bp, Artificial Sequence
  Synthetic Polynucleotide encoding a CAR with optional accessory module(s)
atggccttaccagtgaccgccttgctcctgccgctggccttgctgctccacgccgccaggccggaccagagcgagctgacccagcctagaagcgtgtccggcagccctggacagagcgtgaccatcagctgtaccggcaccgagagagatgtgggcggctacaactacgtgtcctggtatcagcagcaccccggcaaggcccccaagctgatcatccacgacgtgatcgagcggagcagcggcgtgcccgatagattcagcggcagcaagagcggcaacaccgccagcctgacaatcagcggactgcaggccgaggacgaggccgactactactgctggtctttcgctggcggctactacgtgttcggcaccggcacagatgtgaccgtgctgggcggaggcggaagtggaggcggaggatctggcggcggaggctctttcgaagtgcagctgctggaatctggcggcggactggtgcagcctggcggatctctgagactgagctgtgccgcctccggcttcaccttcagcacctaccagatgagctgggtgcgccaggcccctggcaaaggactggaatgggtgtccgggatcgtgtccagcggcggctctacagcctacgccgatagcgtgaagggccggttcaccatcagccgggacaacagcaagaacaccctgtacctgcagatgaacagcctgagagccgaggacaccgccgtgtactattgtgccggcgagctgctgccctactacggcatggatgtgtggggccagggcaccaccgtgaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2412 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccggaccagagcgagctgacccagcctagaagcgtgtccggcagccctggacagagcgtgaccatcagctgtaccggcaccgagagagatgtgggcggctacaactacgtgtcctggtatcagcagcaccccggcaaggcccccaagctgatcatccacgacgtgatcgagcggagcagcggcgtgcccgatagattcagcggcagcaagagcggcaacaccgccagcctgacaatcagcggactgcaggccgaggacgaggccgactactactgctggtctttcgctggcggctactacgtgttcggcaccggcacagatgtgaccgtgctgggcggaggcggaagtggaggcggaggatctggcggcggaggctctgaagtgcagctgctggaatctggcggcggactggtgcagcctggcggatctctgagactgagctgtgccgccagcggcttcaccttcagcacctacgagatgcactgggtgcgccaggcccctggcaaaggactggaatgggtgtccgtgatcctgagcagcggcggagagacaaactacgccgacagcgtgaagggccggttcaccatcagccgggacaacagcaagaacaccctgtacctccagatgaacagcctgcgggccgaggacaccgccgtgtactattgtgccggaatgctgctgccctactacggcatggatgtgtggggccagggcaccaccgtgaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2413 - DNA, 3009 bp, Artificial Sequence
  Synthetic Polynucleotide encoding a CAR with optional accessory module(s)
atggccttaccagtgaccgccttgctcctgccgctggccttgctgctccacgccgccaggccgggctggtttctggacagccctgacagaccctggaatcctccaacattcagccccgctctgctggtggttaccgagggcgataatgccaccttcacctgtagcttcagcaacaccagcgagagcttcgtgctgaactggtacagaatgagccccagcaaccagaccgacaagctggccgcctttcctgaggatagaagccagcctggacaggactgccggttcagagttacccagctgcctaacggcagagacttccacatgagcgttgtgcgggccagaagaaacgacagcggcacatatctgtgcggagccatctctctggcccctaaggctcagatcaaagagagcctgagagccgagctgagagtgacagaaagacgggccgaagtgcccacagctcacccttcaccttctccaagacctgccggccagttccagacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2414 - DNA, 3294 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccaggatgtgtctacagccgtggcctggtatcagcagaagcctggaaaggcccctaagctgctgatctacagcgccagctttctgtacagcggcgtgcccagcagattttctggcagcggctctggcaccgacttcaccctgacaatatccagcctccagcctgaggacttcgccacctactactgccagcagtacctgtatcaccccgccacctttggacagggcaccaaggtggaaatcaagagaggcggaggcggaagtggaggcggaggatctggcggcggaggctctgaagtgcagctggttgaatcaggtggcggcctggttcaacctggcggatctctgagactgagctgtgccgccagcggcttcacctttagcgacagctggattcactgggtccgacaggcccctggcaaaggacttgaatgggtcgcctggatcagcccttatggcggcagcacctattacgccgacagcgtgaagggcagattcaccatcagcgccgacaccagcaagaacaccgcctacctccagatgaactccctgagagccgaagataccgccgtgtactactgcgccagaaggcattggcctggcggctttgattattggggccagggcacactggtcaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2415 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggccatcgtgatgacccagacaccttctccagtgtctgccgccgttggcggcacagtgacaatcaactgtcaggccagcgagagcgtgtacagcaacaactacctgagctggttccagcagaagcccggccagcctcctaagctgctgatctacctggcctccacactggcaagcggagtgcccagtagattcaaaggcagcggctctggcacccagttcaccctgacaattagcggcgtgcagtgtgacgatgccgccacctattactgcatcggcggcaagagcagcagcaccgatggcaatgcttttggcggcggaacagaggtggtcgttagaggcggaggcggaagtggaggcggaggatctggcggcggaggctctcaatctctggaagaaagcggaggcagactggtcaagcccgacgagacactgaccatcacctgtaccgtgtccggcatcgacctgagcagcaatggactgacctgggtccgacaagctcctggcgaaggactggaatggatcggcaccatcaacaaggacgccagcgcctactatgcctcctgggccaaaggcaggctgaccatctctaagcccagctccacaaaggtggacctgaagatcacaagccccaccaccgaggacaccgccacatacttttgtggccggatcgccttcaagaccggcacctctatttggggacctggcacactggtcaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2416 - DNA, 3291 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggcgctgaagtgaagaaacctggggcctctgtgaaggtgtcctgcaaggcttccggctacacctttaccagctacgacgtgcactgggtccgacaggctccaggacaaagactggaatggatgggatggctgcacgccgataccggcatcaccaagttcagccagaaattccagggccgcgtgacaatcaccagagacacatctgccagcaccgcctacatggaactgagcagcctgagaagcgaggacaccgccgtgtactactgcgccagagagagaatccagctttggttcgactactggggccagggaaccctggtcacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2417 - DNA, 3348 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgatgacccagagccccctgagcctgcctgtgacacctggcgagcctgccagcatctcctgtagaagcagccagagcctgctgcacagcaacggctacaactacctcgtgtggtatctccagaagcccggccagagccctcaactgctgatctacctgggcagcatcagagccagcggcgtgcccgatagattttccggcagcggctccggcaccgacttcaccctgaagatcagccgggtggaagccgaggacgtgggcgtgtactactgtatgcagcccctccagacccccatcaccttcggccagggcaccagactggaaatcaagagaggcggaggcggaagtggaggcggaggatctggcggcggaggctctggactccagtgtgtggccgctcctagatgggtgctgagccaggtgcaactccagcagtggggagccggactgctgaagcctagcgagacactgagcctgacatgcgccgtgtacggcggcagcttcagcggcaattactggtcctggatcagacagccccctggcaagggcctggaatggatcggcgagatcaaccacagcggcagcaccaactacaaccccagcctgaagtccagagtgaccatcagcgtggacaccagcaagaaccagttctccctgaagctgagcagcgtgacagccgccgacaccgccgtgtattactgtgccagaggcggctcctacaattacttcgactactggggccagggaaccctcgtgaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2418 - DNA, 3339 bp, Artificial Sequence
  Synthetic Polynucleotide encoding a CAR with optional accessory module(s)
atggccttaccagtgaccgccttgctcctgccgctggccttgctgctccacgccgccaggccggaccagctgacacagagccctagcagcgtgtcagccagcgtgggcgacagagtgaccatcacctgtagagccagccggggcatcagctcttggctggcctggtatcagcagaagcccggcaaggcccccaagctgctgatctacacagccagcagcctccagagcggcgtgcccagcagattttctggcagcggctccggcaccgacttcaccctgacaatcagcagcctccagcccgaggacttcgccacctactactgccagcaggcttacagcttcccccggacctttggccagggcaccaaggtggaaatcaagcggggcggaggcggaagtggaggcggaggatctggcggcggaggctctgtggctgctcctagatgggtgctgagccaggtgcagctccaggaatctggccccggactcgtgaagcctagccagaccctgagcctgacctgtaccgtgtctggcggcagcatcagcagcggcggctactactggatctggatcagacagcaccctggcaagggcctggaatggatcggctacatctactacaacggcaacacctactataaccccagcctgaagtcccgcgtgaccatgagcgtggacaccagcaagaaccagttctccctgaagctgtccagcgtgacagccgccgataccgccgtgtactactgcgccagagatggcatcaccatgatccggggctactattacggcatggacgtgtggggccagggaaccaccgtgaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2419 - DNA, 3261 bp, Artificial Sequence
  Synthetic Polynucleotide encoding a CAR with optional accessory module(s)
atggccttaccagtgaccgccttgctcctgccgctggccttgctgctccacgccgccaggccggacatcgtcgtgacacagagccctgcttccctggccgtgtccctgggacagagagccaccatcagctaccgggccagcaagagcgtgtccaccagcggctacagctacatgcactggaaccagcagaagcccggccagccccctagactgctgatctacctggtgtccaacctggaaagcggcgtgcccgccagattttctggcagcggctctggcaccgacttcaccctgaacatccaccccgtggaagaagaggacgccgccacctactactgccagcacatcagagagctgaccagaagcgagggcggaccctcttggaagggcggaggcggaagtggaggcggaggatctggcggcggaggctctgaagtgaagctggaagagtctggcggcgaccttgtgaagcctggcggcagcctgaagctgagctgtgccgccagcggctttaccttctccggctacggcatgagctgggtgcgccagacccccgacaagagactggaatgggtggcaaccatcagcagcggcggcagctacacctactatcccgacagcgtgaagggccggttcaccatctccagagacaacgccaagaacaccctgtacctgcagatgtcctccctgaagtccgaggacaccgccatgtactattgcgccaggcacgaaggcggctactacggcagttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2420 - DNA, 3309 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcagcctgtctgccagcgtgggcgacagagtgaccatcacctgtagagccagccagggcatcagcaactacctggcctggtatcagcagaaaaccggcaaggtgcccaagttcctgatctacgaggccagcaccctgcagagcggcgtgccaagtagattttccggcggaggcagcggcaccgacttcaccctgacaatcagctccctgcagcccgaggacgtggcaacctactactgccagaactacaacagcgcccccttcaccttcggccctgggaccaaggtggacatcaagggcggaggcggaagtggaggcggaggatctggcggcggaggctctcaggtgcaactggtggaatctggcggaggcgtggtgcagcctggcagaagcctgagactgagctgtgccgccagcggcttcgccttcagcagatacggaatgcactgggtgcgccaggcccctggcaaaggactggaatgggtggccgtgatttggtacgacggcagcaacaagtactacgccgacagcgtgaagggccggttcaccatcagccgggacaacagcaagaacacccagtacctgcagatgaacagcctgcgggccgaggataccgccgtgtactattgtgccagaggcggcgacttcctgtactactactattacggcatggacgtgtggggccagggaaccaccgtgaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2421 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctaccagcgtgggcgatagagtgaccctgacctgcaaggccagccaggatgtgggaaccgccgtggactggtatcagcagaagcctggccccagccccaagctgctgatctactgggccagcaccagacacaccggcatccccagcagattttccggcagcggctccggcaccgacttcaccctgacaatcagctccctgcagcccgaggacttcgccgactactactgccagcagtacaacagctaccccctgaccttcggccctgggaccaaggtggacatcaagggcggaggcggaagtggaggcggaggatctggcggcggaggctctgaagtgcaactggtgcagagcggccctgaagtgaagaaacccggcgctaccgtgaagattagctgcaagaccagcggctacaccttcaccgagtacaccatccactgggtcaagcaggcccctggcaagggcctggaatggatcggcaacatcaaccccaacaacggcggcaccacctacaaccagaagttcgaggacaaggccaccctgaccgtggacaagagcaccgacaccgcctacatggaactgagcagcctgcggagcgaggataccgccgtgtactattgtgccgccggatggaacttcgactactggggacagggcaccctgctgaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2422 - DNA, 3285 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacatctacccctacctgaactggttccagcagaagcccggcaaggcccccaagaccctgatctaccggaccaacagactgctggacggcgtgcccagcagattttctggcagcggctccggcaccgacttcaccttcaccatcagctccctccagccctactactgcctccagtacgacgagttccccctgacctttggagccggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcaccagcaacatgggcgtgggctggatcagacagcctcccggaaaagccctggaatggctggcccacatttggtgggacgacgacaagtactacagccccagcctgaagtcccggctgacaatcaccaaggacaccagcaagaaccaggtggtgctgaccatgaccaacatggaccccgtggacaccgccacctactattgcgtgcggagcaactacggctacgcttggtttgcctactggggccagggcaccctcgtgaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2423 - DNA, 3285 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccagaaattcatgagcaccagcgtgggcgacagagtgaacgtgacctgcaaggccagccagaacgtgggcaccaacgtcgtgtggtatcagcagaaaaccggccagagccccaaggccctgatccacagcgccagctacagatacagcggcgtgcccgacagattcaccggcagcggctctggcaccgacttcaccctgaccctgagcaacgtgcagagcgaggacctggccgaatacttctgccagcactacaacagcttcccttacaccttcggcggaggcaccaagctggaaatcaagagaggcggaggcggaagtggaggcggaggatctggcggcggaggctctcaggtgcaactccagcagagcggagccgaactcgtgcggcctggcgtgtccgtgaagattagctgcaagggctccggctacaggttcaccgactaccccatccactgggtcaagcagagccacgccaagagcctggaatggatcggcatcatcagcacctactacggcgacgtgaccaacaaccccaagttccggggcaaggccaccatgacagtggacaagagcagcaccaccgcctacatggaactggcccggctgaccagcgaggactccgccatctactactgcgcccggaacgacctgttcgcctattggggccagggcaccctcgtgacagtgtctgctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2424 - DNA, 3294 bp, Artificial Sequence
  Synthetic Polynucleotide encoding a CAR with optional accessory module(s)
atggccttaccagtgaccgccttgctcctgccgctggccttgctgctccacgccgccaggccggacatcaagatgacccagagccccagctctatgtacgccagcctgggcgagcgcgtgaccatcacctgtaaagccagccccgacatcaacagctacctgagctggttccagcagaagcccggcaagagccccaagaccctgatctaccgggccaacagactggtggatggcgtgcccagcagattctctggcggcggaagcggccaggactacagcctgaccatcaactccctggaatacgaggacatgggcatctactactgcctccagtacgacgagttcccctacaccttcggcggaggcaccaagctggaaatgaaaggcggaggcggaagtggaggcggaggatctggcggcggaggctctgaagtgaagctggtggaatcaggaggaggcctcgtgaaacctggcggctctctgaagctgagctgtgccgccagcggcttcaccttcagcagctacgccatgagctgggtgcgccagattcccgagaagcggctggaatgggtggcctccattagcagaggcggcaccacctactaccccgacagcgtgaagggccggttcaccatctccagagacaacgtgcggaacatcctgtacctccagatgagcagcctgcggagcgaggacaccgccatgtactactgcggcagatacgactacgacggctactacgctatggactactggggccagggcaccagcgtgaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2425 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccggacgacgtggtcgtgacccctgtgtcctgcttcctgagctgcatctctggcgccgagggccaccacctgattcagggccagcagaagtgccagtacatctggctgctgtacgccctggaacccaccgagacaagaaccgccacccagacccctcacctgtcctgcatccagcccagaatctggggaccctgccaggtgcagtggcagtgggtgtgggatagactgcacccccagcaccctagttgtggcggcggaggctgttgcaacctgctgctgtctgcccacggcgcctacacatttggcggaggcacccggctggaactgaaaggcggaggcggaagtggaggcggaggatctggcggcggaggctctgaagtgaagctccaggaaagcggccctgagctcgtgaagcctggcgcctctgtgaagatgagctgcaaggccagcggctacaccttcaccagctacgtgatgcactgggtcaagcagaagcccggccagggcctggaatggatcggctacatcaacccctacaacgacggcaccaagtacaacgagaagttcaagggcaaggccaccctgaccagcgacaagagcagcagcaccgcctacatggaactgagcagcctgacctccgaggacagcgccgtgtactactgcgcccggtggaaaatctactacggcaactacgaggactactggggccagggcacacccctgacagtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2426 - DNA, 3393 bp, Artificial Sequence
  Synthetic Polynucleotide encoding a CAR with optional accessory module(s)
atggccttaccagtgaccgccttgctcctgccgctggccttgctgctccacgccgccaggccggacgaattccaggtgcaactggtgcagtctggcggagggctggtgcagccagggggatctctgagactgagctgtgccgccagcgacttcgacttcgccgcctacgagatgagctgggtgcgccaggctcctggacagggactggaatgggtggccatcatcagccacgacggcatcgacaagtattacaccgacagcgtgaagggccggttcaccatcagccgggacaacagcaagaacaccctgtacctgcagatgaataccctgcgggccgaggacaccgccacctactattgcctgagactgggagccgtgggccagggcacacttgtgacagtgtctagcctcgagggaggaggcggctccgggggaggcggaagtggaggcggaggatctgggtctggaggaagcggatctggaggctcagggtcagggggctcaggcagtggaggcagcttcgaacaggtgcaactggtgcagagcggaggcggactggtgcagcctgggggcagtctgaggctgtcttgtgccgcctccgatttcgccttcgatgattacgagatgtcttgggtgcggcaggccccaggcaaagccctggaatggatcggcgacatcaaccacagcggcaccaccatctacaaccccagcctgaagtccagagtgaccatctccagagacaactccaagaatactctgtacctgcagatgaacacactgagagccgaagatacagccatctactactgcgccagaccccactacggcgactacagcgacgccttcgacatctggggccagggaaccatggtcaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2427 - DNA, 3318 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtccgtgtctccaggcgaaagagccaccctgagctgtagagccagccagagcgtgtccagcaacctggcctggtatcagcagaagcccggccaggctccccggctgctgatctatggcgcttctaccagagccaccggcatccccgccagattttctggcagcggctccggcaccgacttcaccctgacaatcagctccctccagtccgtggacagcgccgtgtactactgccagcagtacaacaactggcccccctacaccttcggccagggcaccaagctggaaatcaagggcggaggcggaagtggaggcggaggatctggcggcggaggctctcaggtgcaactgctggaaagcggagggggcgtggtgcagcctggaagaagcctgagactgagctgtgccgccagcggcttcaccttcagcttctacggaatgcactgggtgcgccaggcccctggcaaaggactggaatgggtggccgccatcagctacgacggcagcaacaagtattacgccgacagcgtgaagggccggttcaccatcagccgggacaacagcaagaacaccctgtacctccagatgaacagcctgcgggccgaggacacagccgtgtattattgcgccaagcggcccaaccagttctactgctccgacggcagatgctacagcatcgactactggggccagggaaccctcgtgaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2428 - DNA, 3306 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctcctagtgcctctgccggcggaacacctggacagagagtgaccatctcctgctccggcagcagcagcaacatcggcagcaacttcgtgtactggtatcagcaactgcccggcaccgcccccaagctgctgatctacagaaacaaccagcggcccagcggcgtgcccgatagattctctggaagcagaagcggcaccagcgccagcctggctggactgagaagcgaggacgaggccgactactactgtgccgccgatagcctgggcggccactacgtgttcggcaccggaacaaaagtgctgggcggaggcggaagtggaggcggaggatctggcggcggaggctctcaggtgcaactggtggaatctggcggaggctctgtgcagcctggcagaagcctgagactgagctgtgaagcctccggcttcaccttcgaggcttacgccatgcactgggtgcgccagccacctggcaaaggactggaatgggtgtccagcatcaactggaacagcggcagaatcgcctacgccgacagcgtgaagggccggttcaccatcagccgggacaacgccagaaacagcctgtacctccagatgaacagcctgcggctggaagataccgccttctactactgcgccaaggacatccggcggttcagcacaggcggagccgagtttgagtattggggccagggcaccctcgtgaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2429 - DNA, 3291 bp, Artificial Sequence
  Synthetic Polynucleotide encoding a CAR with optional accessory module(s)
atggccttaccagtgaccgccttgctcctgccgctggccttgctgctccacgccgccaggccggagaacgtgctgacacagagccctgccatcatgagcgcttccccaggcgagaaagtgaccatgacatgtagcgccagcagcagcgtgtcctacatgcactggtatcagcagaagtccagcacaagccccaagctgtggatctacgacaccagcaaactggcctctggcgtgccaggcagattttctggcagcggcagcggaaacagctacagcctgacaatcagcagcatggaagccgaggacgtggcaacctactactgctttcaaggcagcggctaccctctgacctttggagccggaacaaagctggaactgaaaggcggaggcggaagtggaggcggaggatctggcggcggaggctctcaggtgcagctgaaagaatctggccctggactggtggcccctagccagtctctgagcatcacctgtaccgtgtccggcttcagcctgagttctcagggcgtgtactgggtccgacagcctcctggaaaaggactggaatggctgggagccatttgggctggcggcagcaccaattacaacagcgccctgatgagccggctgagcatctccaaggacaacagcaagagccaggtgttcctgaagatgaacagcctccagaccgacgacaccgccatgtactactgcgccagagtggatggctaccggggctacaacatggactattggggccagggcaccagcgtgacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2430 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgacgccagcaacctggaaaccggcgtgcccagcagattttccggcagcggctctggcaccgacttcaccttcaccatcagctccctccagcccgaggacattgccacctactactgccagcagtacgacaacctgcccctgacctttggcggaggcaccaaggtggacatcaagagaggcggaggcggaagtggaggcggaggatctggcggcggaggctctcaggtgcaactggtggaatctggcggcggagtggtgcagcctggcagaagcctgagactgagctgtgccgccagcggcttcacctttagcagctacgccatgcactgggtgcgccaggcccctggaaaaggcctggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgtgccagggctcacaacagcagctcttggagcttcgactactggggccagggcaccctcgtgaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2431 - DNA, 3330 bp, Artificial Sequence
  Synthetic Polynucleotide encoding a CAR with optional accessory module(s)
atggccttaccagtgaccgccttgctcctgccgctggccttgctgctccacgccgccaggccggacgacgtcgtgatgacccagagccctctgagcctgcctgtgtccctgggcgatcaggccagcatctcctgcagatccagccagagactggtgcacagcaacggcaacacctacctgcactggtatctgcagaagcccggccagagccccaagctgctgatctaccgggtgtccaacagattccccggcgtgcccgatagattcagcggctctggcagcggcaccgacttcaccctgaagatcagccgggtggaagccgaggacctgggcatctatttctgcagccagagcacccacgtgccctacacctttggcggaggcaccaagctggaaatcaagcggggcggaggcggaagtggaggcggaggatctggcggcggaggctctgaagtgcggctgcagcagtctggccccgacctgattaagcctggggccagcgtgaagatgagctgcaaggccagcggctacaccttcaccggctacgtgatgcactgggtcaagcagaggccaggccagggcctggaatggatcggcttcatcaacccctacaacgacgacatccagagcaacgagcggttccggggcaaggccaccctgaccagcgataagagcagcaccaccgcctacatggaactgagcagcctgacctccgaggacagcgccgtgtactactgtgctaggggagccggctacaacttcgacggggcctacagattcttcgacttttggggccagggcaccacactgaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2432 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccggacagctacgagctgacccagcctcctagcgtgtccgtgtctcctggacagaccgccaccatctcttgcagcggcgatcaactgggcgggaagtacggccactggtatcagaagaagcccggccagagccccgtgctggtgctgtaccaggacagaaaacggcctgccggcatccccgagagattcagcggaagcagcagcggcaacaccatcaccctgaccatcagcggcacccaggccgtggatgaggccgactactactgccaggcttgggacaccaatctgggcggcgtgttcggcggaggcaccaaagtgacagtgctgggacagggcggaggcggaagtggaggcggaggatctggcggcggaggctctcaggtgcaactggtggaaagcggagccgaagtgaagaaacctggggccagcgtgaaggtgtcctgcaaggccagcggctacacctttaccggctactacatgcactgggtgcgccaggctccaggccagggactggaatggatgggccggatcaaccccaatagcggcggcaccaactacgcccagaaattccagggcagagtgaccatgaccagagacaccagcatcagcaccgcctacatggaactgagccggctgagaagcgacgacaccgccgtgtactactgcgccagccctagaggcagaggcagcgccttcgatatttggggccagggcacactcgtgaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2433 - DNA, 3312 bp, Artificial Sequence
  Synthetic Polynucleotide encoding a CAR with optional accessory module(s)
atggccttaccagtgaccgccttgctcctgccgctggccttgctgctccacgccgccaggccggacaacttcatgctgacccagccccacagcgtgtccgagagccctggcaagaccgtgaccatctcctgcaccagaagcagcggctctatcgccagcaaatacgtgcagtggtatcagcagaggcccggcagcagccctaccaccgtgatctacgaggacaaccagaggcctagcggcgtgcccgatagattcagcggcagcatcgacaccagcagcaacagcgccagcctgaccatcagcggcctgagaacagaggacgaggccgactactactgccacagctacgacagcaacaaccactccgtgttcggcggaggcaccaaagtgacagtgctgggacagggcggaggcggaagtggaggcggaggatctggcggcggaggctctgaagtgcaactggtggaaagcgggggaggcgtggtgcagccaggcggatctctgagactgagctgtgccgccagcggcttcaccttcagcagctacgccatgagctgggtgcgccaggcccctggaaaaggcctggaatgggtgtccgccatctctggctctggcggcagcacctactacgccgatagcgtgaagggccggttcagcatcagccgggacaacagcaagaacaccctgtacctccagatgaacagcctgcgggccgaggacaccgccgtgtactactgtgccagaaccagaagctccggggccttcgacatctggggccagggaacactcgtgaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2434 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggacatccagatgaaccagagccccagcagcctgagcgccagcctgggcgataccatcaccatcacctgtcacgccagccagaacatcaacgtgtggctgagctggtatcagcagaagcccggcaacatccccaagctgctgatctacaaggccagcaacctgcacaccggcgtgcccagcagattttctggcagcggctctggcaccggcttcaccattaccatcagctccctccagcccgaggacattgccacctactactgccagcagggccagagctacccctggacatttggcggaggcaccaagctggaaatcaagagaggcggaggcggaagtggaggcggaggatctggcggcggaggctctgaagtgcaactccagcagagcggcccagagcttgtgaagcctggcgcttccgtgaagattagctgcaaagccagcggctacagcttcaccggctacttcatgaactgggtcaagcagagccacggcaagagcctggagtacatcggcagattcaacccctacaacggcgagacactgtacaaccagaagttcaagggcaaggccaccctgaccgtggacaagagcagcagcaccgtgcacatggaactgctgagcgtgaccagcgaggacagcgccgtgtactactgtggcagaagcggcaacgacgacgctatggactattggggccagggcaccagcgtgaccgtgtctagtgctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2435 - DNA, 3300 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcatcctgagcgccagcgtgggcgacagagtgaccatcacctgtcgggccagccagagattcggcgactacctggcctggtatcagcagaagcctggacaggcccccaagctgctgatctacggcgcttccacactccagagcggcgtgcccagcagattttctggcagcggctccggcaccgagttcaccctgacaatcagcggcctccagcccgaggacttcgccacctactattgccagcaggccaacagcttccctatcaccttcggcaagggcacccggctggacatcagaagaggcggaggcggaagtggaggcggaggatctggcggcggaggctctcaggtgcagctggtgcagtctggggccgaagtgaagaaacccggcagcagcgtgaaggtgtcctgcaaggcttccggcggcaccttcagcagctacgccatttcttgggtgcgccaggccccaggacagggcctggaatggatgggctggatcaacgtgggcaacggcaacgccatctacagccagaaattccagggccgcgtgacaatcaccagagacaccagcgccaccaccgcctacatggaactgagcagcctgcggagcgaggacaccgccgtgtactactgtgccagggatggcgagagagcctgggacctggattattggggccagggcacactcgtgaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2436 - DNA, 3315 bp, Artificial Sequence
  Synthetic Polynucleotide encoding a CAR with optional accessory module(s)
atggccttaccagtgaccgccttgctcctgccgctggccttgctgctccacgccgccaggccggacgagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctacacattcggccagggcaccaagctggaaatcaagagaggcggaggcggaagtggaggcggaggatctggcggcggaggctctcaggtgcaactggtgcagtctggcggcggagtggtgcagcctggaagaagcctgagactgtcctgtgccgccagcggcttcaccttcagcagctacgccatgcactgggtgcgccaggcccctggaaaaggactggaatgggtggccgtgatctcctacgacggcagcaacaagtattacgccgacagcgtgaagggccggttcaccatctccagagacaacagcaagaacaccctgtacctccagatgaacagcctgcgggccgaggacacagccgtgtattattgcgccagagagctgcggttcctggaatggtccagcgacgccttcgacatctggggccagggaacaatggtcaccgtgtcctccacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2437 - DNA, 3300 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctgccaccctgtctctgagccctggcgaaagagccaccctgagctgtagagccagccagagcgtgcggagctacctggcctggtatcagcagaagcctggacaggcccccagactgctgatctacgacgccagcaatcgggccacaggcatccccgccagattttctggctctggcagcggcaccgacttcaccctgacaatcagcagcctggaacccgaggacttcgccgtgtactactgccagcagcggagcaactggccccctacctttggacagggcaccaaggtggaaatcaagggcggaggcggaagtggaggcggaggatctggcggcggaggctctcaactccaggtgcaggaatctggccccggactcgtgaagcccagcgagacactgagcctgacctgtaccgtgtccggcggcagcatcagcaacagctacttctcctggggctggatcagacagccccctggcaagggcctggaatggatcggcagcttctactacggcgagaaaacctactacaaccccagcctgaagtccagagccaccatcagcatcgacaccagcaagagccagttctccctgaagctgagcagcgtgacagccgccgacaccgccgtgtattattgccccagaggccccaccatgatccggggcgtgatcgactcttggggccagggaacactcgtgaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2438 - DNA, 3291 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggtgccgaagtgcggaagcctggcagctctgtgaaggtgtcctgtaaagcctccggcggcagcttcaacaactaccccatcttctgggtccgacaggcccctggacagggctttgaatggatgggcagaatcatccccatcctgggcatcaccgcctacgctcagaaattccagggccgcgtgacaatcaccgccgacaagtctacaagcacagcctacatggaactgaacagcctgcggagcgaggacaccgccgtgtattattgtgccggcggagatgacctggacgcctttgacatttggggccagggaacaatggtgtccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2439 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacccccctgagcctgcctgtgacacctggcgagcctgccagcatctcctgcagaagcagcagaagcctgctggacagcgacgacggcaacacctacctggactggtatctgcagaaacccggccagagcccccaactgctgatctacaccctgagctacagagccagcggcgtgcccgatagattttccggctctggcagcggcaccgacttcaccctgaagatcagccgggtggaagccgaggacgtgggcgtgtactactgtatgcagcgggtggaatttcccatcaccttcggccagggcaccagactggaaatcaagagaggcggaggcggaagtggaggcggaggatctggcggcggaggctctcaggtgcaactggtggaatctggcgggggagtggtgcagcctggcagatccctgagactgagctgtgccgccagcggcttcatcttcagcagatacggaatgcactgggtgcgccaggcccctggcaagggactgaaatgggtggccgtgatttggtacgacggcagcaacaagctgtacgccgacagcgtgaagggccggttcaccatcagcagagacaacagcaagaacaccctgtacctgcagatgaacagcctgcgggccgaggacaccgccgtgtactattgcgccagagactactacgacaacagccggcaccactggggcttcgactattggggccagggaacccttgtgaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2440 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggagatccagatgacccagagccccagcagcatgtctgccagcctgggcgacaccatcaccatcacatgccaggccacccaggacatcttcaagaacctgaactggtatcagcagaagcccggcaagccccccagcctgctgatctactatgccaccgaactggccgagggcgtgcccagcagattttctggcagcggcagcggctccgactacagcctgaccatcagcaacctggaaagcgaggacttcgccgcctactactgcctccagttcttcgagttcccattcaccttcggctccggcaccaagctggaaatgaagggcggaggcggaagtggaggcggaggatctggcggcggaggctctcaggtgcaactccagcagtctggcgctgagcttgtgcggcctggcacctctgtgaaggtgtcctgtaaagccagcggctacgtgttcaccaactactggatcgagtggatcaagcagcggccaggccagggcctggaatggatcggcgtgatgaatccaggcagcggcgagacaacctacaacgagaagttcaagggcaaggccaccctgaccgccgacaagagcagcagcacagcctacatgcaactgtcctccctgaccagcgtggacagcgccgtgtacttctgcgccagggaccacgaccgggactactacgctatggactactggggccagggcaccagcgtgaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2441 - DNA, 3288 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacacagagccccgccatcctgtccgtgtctccaggcgagagagtgtcctttagctgccgggccagccagaacatcggcaccagcatccactggtatcagcagcggaccaacggcagccccagactgctgattaagtacgccagcgagtccgtgtccggcatccccagcagattttctggcagcggctccggcaccgacttcaccctgagcatcaacagcgtggaaagcgaggacattgccgactactactgccagcacaccaatagctggcccaccacctttggcggaggcaccaagctggaaatcaagagaggcggaggcggaagtggaggcggaggatctggcggcggaggctctcaggtgcaactccagcagtccgacgccgagcttgtgaagcctggcgcttccgtgaagattagctgcaaggccagcggctacaccttcaccgaccacgccattcactgggtcaagcagaagcccgagcagggcctggaatggatcggctacttcagccccggcaacggcgacatcaagtacaacgagaagttcaagggcaaggccaccctgaccgccgacaagagcagcagcacagcctacatgcaactgaacagcctgaccagcgaggactccgccgtgtacttctgcaagcggagctacggcaactacgactactggggccagggcaccacactgaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2442 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgcaagagcagccagagcctgctgaacagcggcgaccagaagaactacctgacctggtatcagcagaagcccggccagccccccaagctgctgatctactgggccagcaccagagaaagcggcgtgcccgatagattcagcggcagcggaagtggcaccgacttcaccctgaccatcagttctcttcaggccgaggacgtggccgtgtactactgccagaacgactacagctaccccctgaccttcggccagggcaccaaggtggaaatcaagggcggaggcggaagtggaggcggaggatctggcggcggaggctctcaggtgcagctggtgcagtctggggccgaagtgaagaaaaccggcagcagcgtgaaggtgtcctgcaaggccagcggctacacctttaccgaccacgccattcacgtgtggcggcaggctccaggacaggccctggaatggatgggccacttcagccccggcaacaccgacatcaagtacaacgacaagttcaagggcagagtgaccctgaccgtggaccgcagcatgagcaccgcctacatggaactgagcagcctgcggagcgaggacaccgccatgtactattgcaagaccagcaccttctttttcgactactggggccagggaacaatggtcaccgtgtccagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2443 - DNA, 3069 bp, Artificial Sequence
  Synthetic Polynucleotide encoding a CAR with optional accessory module(s)
atggagctgactgaattgctcctcgtggtcatgcttctcctaactgcaaggctaacgctgtccagcccggctcctcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggaccctaatgccatcttcctgagcttccaacacctgctccgaggaaaggtgcgtttcctgatgcttgtaggagggtccaccctctgcgtcaggcgggccccacccaccacagctgtccccagcagaacctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2444 - DNA, 3300 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgtccattgccgtggcctggtatcagcagaagcccggcaaggcccccaaggtgctgatctacagcgccagctacagatacaccggcgtgcccgacagattcagcggctctggcagcggcaccgacttcaccttcaccatcagctccctccagcccgaggatattgccgtgtactactgccagcagcactacatcacccccctgacctttggcggaggcaccaaggtggaaatcaagggcggaggcggaagtggaggcggaggatctggcggcggaggctctcagatccaactggtgcagagcggccacgaagtgaagaaacctggggccagcgtgaaggtgtcctgcaaagccagcggctacacctttaccaactacggcatgaactgggtgcgccaggcccctggacagggcctggaatggatgggctggatcaacaccaagaccggcgagcccacctacgccgaagagttcaagggcagattcgtgttcagcctggaaaccagcgcctccaccgcctacctccagatcagctctctgaaggccgaggacaccgccatgtacttttgcggcagaggcggctacggcagcagctactggtacttcgatgtgtggggccagggcaccaccgtgaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2445 - DNA, 3306 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgccgggccagcaagagcgtgtccaccagcggctacagctacatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagagctgccctacaccttcggccagggcaccaagctggaaatcaagggcggaggcggaagtggaggcggaggatctggcggcggaggctctcaggtgcaactccaggaatctggccctggccttgtgaagcccagcgagacactgagcctgacctgtaccgtgtccggcggcagcatcagctcttacggcgtgcactggattcggcagcctccaggcaagggcctggaatggatcggcgtgatctggacctccggcgtgaccgactacaacagcgccctgatgggcagagtgaccatctccgtggacaccagcaagaaccagttcagcctgaagctgagcagcgtgacagccgccgataccgccgtgtattattgcgccagagatggcgactacgaccgctacacaatggactactggggccagggaacccttgtgaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2446 - DNA, 3243 bp, Artificial Sequence
  Synthetic Polynucleotide encoding a CAR with optional accessory module(s)
atgacagccctgttcctgatgtccatgctgttcggcctggcctgcggacaggccatgtctttctgtatccccaccgagtacaccatgcacatcgagagaagagagtgcgcctactgcctgaccatcaacaccacaatctgcgccggctactgcatgacacgggatattaacggcaagctgttcctgcctaagtacgccctgagccaggacgtgtgcacctaccgggacttcatctaccggaccgtggaaatccctggctgccctctgcatgtggccccttactttagctaccccgtggctctgagctgcaagtgcggcaagtgcaacaccgactacagcgactgtatccacgaggccatcaagaccaactactgcaccaagcctcagaaaagctacctcgtgggcttctctgttggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2447 - DNA, 3294 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctcctagcgtgtccgtgtctcctggccagaccgccagcatcacctgtagcggcgataagctgggcgataagtacgcctgctggtatcagcagaagcccggccagtctcccgtgctcgtgatctaccaggacagcaagaggcccagcggcatccccgagagattcagcggcagcaacagcggcaataccgccaccctgaccatcagcggcacccaggctatggacgaggccgactactactgccaggcttgggatagcagcaccgccgtggtgtttggcggaggcaccaagctgacagtgctgggcggaggcggaagtggaggcggaggatctggcggcggaggctctcaggtgcagctggtgcagtctggggccgaagtgaagaagcctggacagagcctgaagatcagctgcaaggccagcggctacagcctgaccgacaactggattggctgggtgcgccagaagccaggcaagggcctggaatggatgggcatcatctaccccggcgacagcgacaccagatacagccctagcttccagggccaagtgaccatctccgccgacaagagcatcaacaccgcctacctccagtggtccagcctgaaagcctccgacaccgccatctactactgtgtgggactggactggaactacaaccccctgcggtactggggacctggcacactcgtgaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2448 - DNA, 3288 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccagaaattcatgagcaccagcgtgggcgaccgggtgtccatcatctgcaaggccagccagaacgtgggcaccttcgtggcctggtatcagcagaagcctggccagagccccaagctgctggtgtacagcgccagcaacagatacaccggcgtgcccgatagattcaccggcagcggctctggcaccgacttcaccctgaccatcaacaacatgcagagcgaggacctggccgactacttctgtcggcagtacagcagctacccctacaccttcggcggaggcaccaagctggaaatcaagggcggaggcggaagtggaggcggaggatctggcggcggaggctctgaagtgcaactccagcagagcggccctgagcttgtgaagccaggggccagcatgaagattagctgcaaagccagcggctacagcttcagcgcctacaccatgaactgggtcaagcagagccacggcaagaacctggaatggatcggcctgattaacccctacaacggcggcaccaactacaaccaggaatttgagggcaaggccaccctgacagtgaacaagagcagcaacaccgccttcatggaactgctgagcctgaccagcgacgacagcgccgtgtactactgcgccagacgggactgggactacttcgactattggggccagggcaccacactgaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2449 - DNA, 3321 bp, Artificial Sequence
  Synthetic Polynucleotide encoding a CAR with optional accessory module(s)
atggccttaccagtgaccgccttgctcctgccgctggccttgctgctccacgccgccaggccggccatccagatgacccagagccctagcagcctgagcgccagcgtgggcgacagagtgaccatcacctgtagagccagccagagcatcagcaactacctgaactggtatcagcagaagcccggcaaggcccccaagctgctgatctatgccgccagctctctccagagcggcgtgcccagcagattttctggcagcggctccggcaccgacttcaccctgacaatcagcagcctccagcccgaggacttcgccacctactactgccagcagagctacagcagcccctccaccacctttggacagggcaccaagctggaaatcaagagaggcggaggcggaagtggaggcggaggatctggcggcggaggctctgaagtgcagctggtggaatctggcggcggactgattcagcctggcggctctctgagactgagctgtgccgcctctggcttcaccgtgtcctccaactacatgagctgggtgcgccaggcccctggcaagggactggaatgggtgtccgtgacatacagcggcggcagcaccagctacgccgatagcgtgaagggccggttcaccatcagccgggacaacagcaagaacaccctgtacctccagatgaacagcctgcgggccgaggacaccgccgtgtactattgtgccaggggaggccggtactgctccagcatcagctgctatgccagaagcggctgcgactactggggccagggaacactcgtgaccgtgtccagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2450 - DNA, 3306 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcggcaccagcctgcactggtatcagcagaagcctggcaaggcccccaagctgctgattaagttcgccagcagactgcagagcggcgtgcccagcagattttctggcagcggctccggcaccgacttcaccctgacaatcagctccctgcagcccgaggacttcgccacctactactgccagcagagccccggcttccctccaacctttggacagggcaccaagctggaaatcaagcggggcggaggcggaagtggaggcggaggatctggcggcggaggctctcaggtgcaactggtggaatctggcggcggacttgtgaagccaggcggcagcctgagactgagctgtgccgccagcggcttcagcatcaccaccagcggctactactggacctggatcagacagttccccggcaagggcctggaatggatgggctacatcggctacaacagcaagacctactacaaccccgccctgaagtcccggatcaccatcagcagagacaacgccaagaacagcctgtacctgcagatgaactccctgagagccgaggataccgccgtgtactactgcgccagatccctgtacggcggctacaaggacgccttcgatagctggggccagggaacccttgtgaccgtgtctagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2451 - DNA, 3321 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacccagagccctctgagcctgcctgtgacacctggcgagcctgccagcatctcctgtagaagcagccagagcctgctgcacagcatcggctacaactacctggactggtatctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagacccccctgacctttggcggaggcaccaaggtggaaatcaagcggggcggaggcggaagtggaggcggaggatctggcggcggaggctctgaagtgcaactggtggaaagcggaggcggcgtggtgcagcctggaagaagcctgagactgagctgtgccgccagcggcttcaccttccggtcctacggaatgcactgggtgcgccaggcccctggcaaaggactggaatgggtggccgtgatctcctacgacggctccaacaagtactacaccgacagcgtgaacggcagattcaccatcagcagagacaacagcaagaacaccctgtacctccagatgaacagcctgcgggccgaggacaccgccgtgtactattgtgctagaggcggaggctactacgagacaagcggccctgattactggggccagggcacactcgtgaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2452 - DNA, 3315 bp, Artificial Sequence
  Synthetic Polynucleotide encoding a CAR with optional accessory module(s)
atggccttaccagtgaccgccttgctcctgccgctggccttgctgctccacgccgccaggccggacgacgtcgtgatgacccagagccctctgagcctgcctgtgacacctggcgagcctgccagcatctcctgtagaagcagccagagcctgctgcacagcatcggctacaactacctgcactggtttctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagacccctcccacctttggacagggcaccagactggaaatcaagcggggcggaggcggaagtggaggcggaggatctggcggcggaggctctcaactccaactccaggaaagcggccctggcctcgtgaagcctagcggcacactgagcctgacatgtgccgtgtctggcggcagcatcagcagcagcaactggtggtcttgggtgcgccagcctcctggcaagggcctggaatggatcggcgaaatctaccacagcggcagcaccaactacaaccccagcctgaagtccagagtgaccatcagcgtggacaagagcaagaaccagttctccctgaagctgagcagcgtgacagccgccgataccgccgtgtactattgcgtgggcagcccctacggcgactacgtgctggattattggggccagggcaccctcgtgaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2453 - DNA, 3324 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagagccctctgagcctgcctgtgacacctggcgagcctgccagcatcagctgtagaagcagccagagcctgctgcacagcaacggccacaactacctggactggtatctccagaagcccggccagagcccccagctgctgatctacctgggcagcaatagagccagcggcgtgcccgatagattcagcggctctggaagcggcaccgacttcaccctgaagatcagccgggtggaagccgaggacgtgggcgtgtactactgtatgcagaccctccagacccccctgacctttggccctggcaccaaggtggacatcaagagaggcggaggcggaagtggaggcggaggatctggcggcggaggctctgaagtgcagctggtggaaacaggcggaggcgtggtgcagcctggcagaagcctgagactgagctgtgccgccagcggcttcaccttcagcagctacggaatgcactgggtgcgccaggcccctggcaaaggactggaatgggtggccgtgatctcctacgacggcagcaacaagtattacgccgacagcgtgaagggccggttcaccatctccagagacaacagcaagaacaccctgtacctccagatgaacagcctgcgggccgaggacaccgccgtgtactattgcgccaaggacagatacggctggggcagcagcttcggccacttcgattattggggccagggcaccctcgtgaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2454 - DNA, 3309 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctggcaccctgagcctgtctctgggagagagagccacactgagctgtcgggccagccagtctatcagcagcagcttcctggcctggtatcagcagaagcccggccaggcccctaagctgctgatctacgccgccagcacaagagccaccggcatccccgatagattcagcggctctggcagcggcaccgacttcaccctgaccatcagcagactggaacccgaggacttcgccgtgtactactgccagcagtacggcagaagcctgagcttcggcggaggcaccaaggtggaagtgaagggcggaggcggaagtggaggcggaggatctggcggcggaggctctcaggtgcaactccagcagtctggccccggactcgtgaagcctagccagacactgagcctgacctgcgccatcagcggcgatagcgtgtccggcaatagcgccacctggaactggatcagacagagcccatctcggggcctggaatggctgggccggacctactaccgcagcaagtggaaccacgactacgccgagagcgtgaagtcccggatcaccatcaaccccgacaccagcaagaaccagttctccttgcaactgaacagcgtgacccccgaggacacagccgtgtattattgcgccagaggcgacagcagctcttggtacgccttcgactattggggccagggcaccctcgtgaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2455 - DNA, 3309 bp, Artificial Sequence
  Synthetic Polynucleotide encoding a CAR with optional accessory module(s)
atggccttaccagtgaccgccttgctcctgccgctggccttgctgctccacgccgccaggccggaccagaccgtcgtgacacagcctcctagcgcctctggcacaccaggccagagagtgaccatctcctgtagcggcagcagcagcaacatcggcagcaactacgtgtactggtatcagcaactgcccggcaccgcccccaagctgctgatctacagaagcaaccagcggcccagcggcgtgcccgatagattttctggcagcaagagcggcaccagcgccagcctggctatctctggacctagaagcgtggacgaggccgactactactgcgccgcctgggacgatagcctgaacggcgtggtgtttggcggaggcaccaagctgacagtgctgggtggcggaggcggaagtggaggcggaggatctggcggcggaggctctcaggtgcaactggtgcagtctggggccgaagtgaagaaacccggcagctccgtgaaggtgtcctgcaaggcttccggcggcaccttcagcagctacgccatttcttgggtgcgccaggcccctggacagggcctggaatggatgggcggcatcatccccatctttggcaccgccaactacgcccagaaattccagggccgcgtgaccatcaccgccgacgagtctacaagcaccgcctacatggaactgagcagcctgcggagcgaggataccgccgtgtactactgtgccagaagaatccccccctactacggcatggacgtgtggggccagggaaccaccgtgaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2456 - DNA, 3309 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtcgtgacacagcctcctagcgtgtcagtggcccctggcaagaccgccagaatcacctgtggccggaacaacatcggcagcaagagcgtgcactggtatcagcagaagcccggccaggctcctgtgctggtggtgtacgacgacagcgacagacccagcggcatccccgagagattcagcggcagcaactccggcaataccgccaccctgaccatcagcagagtggaagccggcgacgaggccgactactactgccaagtgtgggacagcagcagcgatcacgtggtgtttggcggaggcaccaagctgacagtgctgggtggcggaggcggaagtggaggcggaggatctggcggcggaggctctgaagtgcaactggtgcagtctggcggaggggtcgtgcggcctggcggatctctgagactgtcttgtgccgccagcggcttcaccttcgacgactacggcatgagctgggtgcgccaggcccctggaaaaggcctggaatgggtgtccggcatcaactggaatggcggcagcaccggctacgccgattctgtgcggggcagattcaccatcagccgggacaacgccaagaacagcctgtacctgcagatgaactccctgcgggccgaggacaccgccctgtactattgcgccagagagcggggctacggctaccacgaccctcacgattattggggccagggcacccttgtcaccgtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2457 - DNA, 3345 bp, Artificial Sequence
  Synthetic Polynucleotide encoding a CAR with optional accessory module(s)
atggccttaccagtgaccgccttgctcctgccgctggccttgctgctccacgccgccaggccggaacagaaactcatcagtgaagaagacctggaattccaggctgtcgtgacacagcctcctagcgcctctggcacaccaggccagagagtgaccatctcctgtagcggcagcagcagcaacatcggcagcaacaccgtgaactggtatcagcaggtgcccggcaccgctcccaagctgctgatctacagcaacaaccagcggcccagcggcgtgcccgatagattttctggcagcaagagcggcaccagcgccagcctggctatctctggactccagtccgaggacgaggccgactactattgcgccgcctgggacgatagcctgaacggctgggtgttcggcggaggcaccaagctgacagtgctgggcggaggcggaagtggaggcggaggatctggcggcggaggctctcagatgcaactggtgcagagcggagccgaagtgaaagagcctggcgagagcctgcggatctcctgcaagggcagcggctacagcttcaccaatttctggatctcttgggtgcgccagatgcccggcaagggcctggaatggatgggcagagtggaccccggctactcctacagcacctacagccctagcttccagggccacgtgaccatcagcgccgacaagagcaccagcaccgcctacctccagtggaacagcctgaaggccagcgacaccgccatgtactactgcgccagagtgcagtacagcggctattacgattggttcgacccctggggccagggcacactcgtgacagtgtcaagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2458 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggaacagaaactcatcagtgaagaagacctggaattcgacatccagatgacccagagccccagcacactgagcgccagcgtgggcgacagagtgaccatcacctgtcgggccagccagaacatcaacaagtggctggcctggtatcagcagaggcccggaaaagccccccagctgctgatctacaaggccagcagcctggaaagcggcgtgcccagcagattttctggcagcggctctggcaccgagtacaccctgaccatcagctccctccagcccgacgacttcgccacctactactgccagcagtacaacagctacgccaccttcggccagggcaccaaggtggaaatcaagagaggcggaggcggaagtggaggcggaggatctggcggcggaggctctcaggtgcagctggtgcagtctggggccgaagtgaagaagcctggcgagagcctgaagatcagctgcaagggctccggctacaacttctctaacaagtggatcggctgggtgcgccagctgcctggcagaggactggaatggatcgccatcatctaccccggctacagcgacatcacctacagccccagcttccagggccgcgtgacaatcagcgccgacaccagcatcaacaccgcctacctgcactggcacagcctgaaggccagcgacaccgccatgtactactgcgtgcggcatacagccctggctggcttcgattattggggcctgggcaccctcgtgaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2459 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccaatacctacctggcctggtatcaccagaggcccggacaggctccccggctgctgatctatggcgcttctagcagagccaccggcatccccgatagattcagcggctctggcagcggcaccgacttcgccctgacaatcagctccctggaacccgaggacttcgccgtgtactactgccagcagtacagcaactcctggaccttcggccagggcaccaaggtggaaatcaagagaggcggaggcggaagtggaggcggaggatctggcggcggaggctctcaggtgcaactggtggaatctggcgggggagtggtgcagcctggcagaagcctgagactgtcttgtgccgccagcggcttcaccttcagcagctacgacatgcactgggtgcgccaggcccctggcaaaggactggaatgggtggccgtgatctcctacgacggcaccaacgagtattacgccgacagcgtgaagggccggttcaccatctccagagacaccagcaagaacaccctgtacctccagatgaacagcctgcgggccgaggacacagccgtgtattattgcgccagagagcggtacttcgactggtccttcgactactggggccagggaaccctggtgtccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2460 - DNA, 3294 bp, Artificial Sequence
  Synthetic Polynucleotide encoding a CAR with optional accessory module(s)
atggccttaccagtgaccgccttgctcctgccgctggccttgctgctccacgccgccaggccggagctgacacaggaccctgctgtgtctgttgccctgggccagacagtgcggattacctgtcaaggcgacagcctgagaagcaactacgccaactggtatcagcagaagcccggacaggctcccgtgctggttatctacggccagaacaacagacccagcggcatccccgatagattcagcggctctagctctggcaataccgccagcctgacaatcactggcgctcaggctgccgatgaggccgactactactgcgatagcagagtgtccaccggcaatcacgtggtgtttggcggcggaacaaagctgacagtgctcggacaaggcggaggcggaagtggaggcggaggatctggcggcggaggctctgaagttcagctggtgcagagcggagccgaagtgaagaaacctggggcctctgtgaaggtgtcctgcaaggcttccggctacacctttaccagctacgccatgcactgggtccgacaggcacctggacaacggcttgaatggatgggctggatcaacgccggcaacggcaacaccaagtacagccagaaattccagggccgcgtgaccatcaccagagatacaagcgccagcaccgcctacatggaactgtctagcctgagatccgaggacaccgccgtgtactactgtgccagagacatcagctacggcagcttcgactattggggccagggcacactggtcaccgttagctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2461 - DNA, 3300 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagacaccagccacactgagcgtgacacctggcgattctgtgtccctgagctgtagagccagccagagcatcagcaacaacctgcactggtatcagcagaagtcccacgagagccccagactgctgattaagaacgccagccagtctatcagcggcatccccagcaagtttagcggctctggcagcggcaccgacttcaccctgagaatcaacagcgtggaaaccgaggacttcgggatgtacttctgccagcagagcaatagctggccctacacatttggctccggcaccaagctggaaatcaaaggcggaggcggaagtggaggcggaggatctggcggcggaggctctcaagtgaagctgcaacagagcggacccgagctggttaagccaggcgcttccgtgaagattagctgcaaggccagcggctacagcttcaccggctactacatgcactgggtcaagcagagccacggcaacatcctggactggatcggctacatctacccctacaacggcgtgtccagctacaaccagaagttcaagggcaaagccactctgaccgtggacaagagcagcagcaccgcctacatggaactgagaagcctgaccagcgaggacagcgccgtgtactattgtgccagagagcggggcctgtaccagctcagagcaatggattattggggccagggcaccagcgtgaccgtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2462 - DNA, 3273 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacacagacccctgccatcatgagcgcctctccaggccagaaagtgaccatcacatgtagcgccagcagcagcgtgaactacatgcactggtatcagcagaagctgggcagcagccccaagctgtggatctacgataccagcaaactggcccctggcgtgccagccagattttctggttctggcagcggcaccagctacagcctgacaatcagcagcatggaagccgaggatgccgccagctacttctgccatcagtggtctagctacccctacacctttggctccggcaccaagctggaaatcaaaggcggaggcggaagtggaggcggaggatctggcggcggaggctctgaagttcagctccaagagtctggccccgacctggtcaagcctagccaaagcctgagcctgacctgtaccgtgaccggctacagcatcacaagcggctatggatggcactggatcagacagttccccggcaacaaactggaatggatgggctacatccactacagcggcagcaccacctacaatcccagcctgaagtcccggatcagcatcagcagagacaccagcaagaaccagttcttcctgcaactgaacagcgtgaccaccgaggacaccgccacctactattgtgctcggagcctgagatattggggccagggcacaaccctgaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2463 - DNA, 3282 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagcgccaccagcagcatcagctacatgcactggtatcagcagaagcccggcaaggcccctaaaggctggatctacgataccagcaaactggcccacggcgtgcccagcagattttctggttctggcagcggcaccgacttcaccctgacaatatctagcctccagcctgaggacttcgccacctactactgccaccagagaagaagctaccccttcaccttcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggcttccggctacacctttaccaatttctggattcactgggtccgacaggctccaggccaaggactggaatggatcggagagatcgaccccagcgacagctacaccaactacaaccagaaattcaaaggccgggtcaccatcaccagagacaccagcacaagcaccgcctacctggaactgagcagcctgagaagcgaggacaccgccgtgtactactgcgccagggaaatcaccaccgtggattattggggccagggaaccctggtcaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2464 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagccagggcttcaacaaatacgtggcctggtatcagcagaagcccggcaaggctcctaagctgctgatctactacaccagcacactccagcctggcgtgcccagcagattttctggctctggcagcggcagagactacaccctgacaatatccagcctccagccagaggacttcgccacctactactgtctccagtacggcaacctgctgtacgcctttggacagggcaccaaggtggaaatcaagagaggcggaggcggaagtggaggcggaggatctggcggcggaggctctgaagttcagcttgtgcagagcggagccgaagtgaagaaacctggggcctctgtgaaggtgtcctgcaaagccagcggctacacctttaccagctactggatcggctgggtccgacaggctcctggacaaggactggaatggatcggcgacatctatcccggcggaggctacaccaactacaacgagaagttcaagggccgcgtgacaatcaccagagacacctctacaagcaccgcctacctggaactgagcagcctgagaagcgaggacaccgccgtgtactactgcgccagactggatggcagcagctacagaggcgctatggattcttggggccagggcacactggtcaccgtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2465 - DNA, 3315 bp, Artificial Sequence
  Synthetic Polynucleotide encoding a CAR with optional accessory module(s)
atggccttaccagtgaccgccttgctcctgccgctggccttgctgctccacgccgccaggccggacatccagctcacacagagcccttctagcctgtctgccagcgtgggcgacagagtgaccatcacatgtagagccagccagagcgtggactacgacggcgacagctacatgaactggtatcagcagaagcccggcaaggcccctaagctgctgatctacgccgccagctatctggaaagcggcgtgccaagcagattttccggctctggcagcggcaccgatttcaccctgacaatatccagcctccagcctgaggacttcgccacctactactgccagcagagccatgaggacccctacacctttggacagggcaccaaggtggaaatcaagagaggcggaggcggaagtggaggcggaggatctggcggcggaggctctgaagtgcaactggttgaatctggcggcggactggttcagcctggcggatctctgagactgagctgtgccgtgtctggctacagcatcaccagcggctactcttggaactggatcagacaggcccctggcaaaggactggaatgggtcgcctccatcacctacgatggcagcaccaactacaaccccagcgtgaagggcagaatcaccatcagcagggacgacagcaagaacaccttctacctgcaaatgaacagcctgagagccgaggacaccgccgtgtactattgtgccagaggcagccactacttcggccactggcattttgctgtgtggggccagggaaccctggtcacagtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2466 - DNA, 3291 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccaggacatccggtactacctgaactggtatcagcagaagcccggcaaggcccctaagctgctgatctatgtggcctccagcctccagagcggagtgccttctagattttctggcagcggctccggcaccgagtttaccctgacagtgtctagcttgcagcccgaggacttcgccacctactactgcctgcaagtgtacagcacccctcggacctttggacagggcaccaaggtggaaatcaaaggcggaggcggaagtggaggcggaggatctggcggcggaggctctgaagtgcagcttgttgaatctggcggcggactggctaagcctggcggatctctgagactgtcttgtgccgccagcggcttccggttcaccttcaacaactactacatggactgggtccgacaggcccctggacaaggacttgaatgggtgtccagaatcagcagcagcggcgaccctacttggtacgccgattctgtgaagggcagattcaccatcagcagagagaacgccaagaacaccctgttcctccagatgaactccctgagagccgaggacaccgccgtgtactattgtgcctctctgaccaccggcagcgattcttggggacagggcgtgctggttaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2467 - DNA, 3294 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatcggaagcctccagagcgaggacttcgccgtgtactactgccagcagtacaagacctggcctcggacctttggacagggcaccaacgtggaaatcaaaggcggaggcggaagtggaggcggaggatctggcggcggaggctctcaagttcagctgcaacaatggggagccggcctgctgaagcctagcgaaacactgtctctgacctgcgccgtgttcggcggctctttcagcggctactactggtcctggatcagacagcctcctggcaaaggactggaatggatcggcgagatcaaccaccggggcaacaccaacgacaaccccagcctgaaaagcagagtgaccatcagcgtggacaccagcaagaaccagttcgccctgaagctgagcagcgtgacagccgctgataccgccgtgtattattgcgccagagagcggggctacacctacggcaatttcgatcactggggccagggcaccctggtcacagtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2468 - DNA, 3297 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccctagcagcgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatctctagcctccagagcgaggacttcgccgtgtactactgccaccagtacagcaactggatgtgcagcttcggccagggcaccaagctggaaatcaaaggcggaggcggaagtggaggcggaggatctggcggcggaggctctgaagttcagctccttgagtcaggtggcggcctggttcaacctggcggatctctgagactgagctgtgccgccagcggcttcacctttagcagatacgccatgaactgggtccgacaggcccctggcaaaggactggaatgggtgtccggcatctctggaagcggcggcagaacctactacgccgattctgtgaagggcagattcaccatcagccgggacaacagcaagaacaccctgtacctccagatgaacagcctgagagccgaggacacagccgtgtattattgcgccaaggaccgggacttttggagcggcccttttgactattggggccagggaaccctggtcaccgttagctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2469 - DNA, 3297 bp, Artificial Sequence; identical to SEQ ID NO: 2468
  Synthetic Polynucleotide encoding a CAR with optional accessory module(s)

SEQ ID NO: 2470 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccgcaggttcagctccagcagtctgatgccgagctggtcaagcctggcagcagcgtgaagattagctgcaaggccagcggctacaccttcaccgatcacgccatccactgggtcaagcagaagcctgagcagggcctcgaatggatcggccactttagccctggcaacaccgacatcaagtacaacgacaagttcaagggcaaagccacactgaccgtggacagaagcagcagcacagcctacatgcagctgaacagcctgaccagcgaggacagcgccgtgtacttctgcaagaccagcaccttctttttcgactactggggccagggcacaaccctgacagtttcttctggcggaggcggaagtggaggcggaggatctggcggcggaggctctgaactggttatgacacagagccccagcagcctgacagtgacagccggcgagaaagtgaccatgatctgcaagtctagccagagcctgctgaactccggcgatcagaagaactacctgacctggtatcagcagaaacccggccagcctcctaagctgctgatcttctgggccagcaccagagaaagcggcgtgcccgatagattcacaggcagcggcagcggaaccgacttcaccctgacaatcagctctgtgcaggccgaggacctggccgtgtattactgccagaacgactacagctaccctctgacctttggagccggcaccaagctggaactgaagacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2471 - DNA, 3306 bp, Artificial Sequence
  Synthetic Polynucleotide encoding a CAR with optional accessory module(s)
atggccttaccagtgaccgccttgctcctgccgctggccttgctgctccacgccgccaggccggaggtgcaactggttgagtctggcggaggactggtgcagcctggaagaagcctgagactgtcttgtgccgccagcggcttcaccttcgacgattatgccatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactactgcgccaaagacaaaggcggaggctactacgacttttggagcggcagcgattattggggccagggcacactggtcacagtgtctagcggcggaggcggaagtggaggcggaggatctggcggcggaggctcttcttctgagctgacacaggaccctgccgtgtctgttgctctgggccagacagtgcggattacctgtcagggcgatagcctgagaagctactacgcctcctggtatcagcagaagccaggccaggctcctgtgctggtcatctacggcaagaacaacagacccagcggcatccccgatagattcagcggaagcagctctggcaataccgccagcctgacaattactggcgctcaggccgaggacgaggccgactactactgcaacagcagagatagcagcggctgggttttcggcggaggcacaaaactgacagtgctgacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2472 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccggaagtgcagctccagcagtctggacctggcctggttaagcctagccagacactgagcctgacctgtgccatcagcggcgatagcgtgctgagcaacagcgacacctggaactggatcagacagagccctagcagaggactggaatggctgggcagaacctaccacagaagcacttggtacgacgactacgccagctctgtgcggggcagagtgtccatcaatgtggacaccagcaagaaccagtacagcctgcaactgaacgccgtgacacctgaggataccggcgtgtactactgcgccagagacagactccaggacggcaactcttggagcgacgcctttgatgtgtggggccagggcacaatggtcaccgtttctagcggcggaggcggaagtggaggcggaggatctggcggcggaggctctcaatctgctctgacacagcctgccagcgtgtcaggatctcctggacagagcatcaccatctcttgcaccggcaccagctctgatgtcggcggctacaattacgtgtcctggtatcagcagcaccccggcaaggcccctaagctgatgatctacgacgtgtccaacagacccagcggcgtgtccaatagattctccggcagcaagagcggcaacaccgccagcctgacaatttctggactgcaagccgaggacgaggccgactactactgtagcagctacaccagcagcagcacactggtgtacgtgttcggcacaggcaccaaagtgaccgtgcttacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2473 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccgcaggtgcaactggttcagtctggggccgaagtgaagaaacctggggcctctgtgaaggtgtcctgcaaggcttccggctacacctttaccagctacgacatcaactgggtccgacaggccacaggccaaggactggaatggatgggctggatgaaccccaacagcggcaataccggctacgcccagaaattccagggcagagtgaccatgaccagaaacaccagcatcagcaccgcctacatggaactgagcagcctgagaagcgaggacaccgccgtgtactattgcgccagaggcgacagcaactactggtcctactacggcatggacgtgtggggccagggaacactggttacagtttctagcggcggaggcggaagtggaggcggaggatctggcggcggaggctctggcggtggtggatctcaatctgtgctgacccagcctagatccgtgtctggctctcctggacagagcgtgaccatctcttgtaccggcaccagctctgatgtcggcggctacaattacgtgtcctggtatcagcagcaccccggcgaagcccctaagctgattatctacgacgccgacaagcggcccagcggcatcagcaatagattcagctctggcaagagcggcaacaccgccagcctgacaatcagcggactccaggtggaagatgaggccgactactactgctgctcctatgccggcggaagcacctgggttttcggaggcggtacaaaagtgaccgtgctgacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2474 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccggaagtgcagctccagcagtctggacctggcctggttaagcctagccagacactgagcctgacctgtgccatcagcggcgatagcgtgtcctctaatagcgccgcctggaactggatcagacagagccctagcagaggactggaatggctgggcagaacctactaccgcagcaagtggtacagcgactacgccgtgtccgtgaagtcccggatcaccatcaatcccgacaccagcaagaaccagttcagcctgcaactgaacagcgtgacccctgaggataccgccgtgtactactgcgccagagatccctacgacttttggagcggctaccccgacgcctttgacatctggggacagggcacaatggtcaccgtttctagcggcggaggcggaagtggaggcggaggatctggcggcggaggctctcaatctgctctgacacagcctgccagcgtgtcaggatctcctggacagagcatcaccatctcttgcaccggcaccagctctgatgtcggcggctacaattacgtgtcctggtatcagcagcaccccggcaaggcccctaaagtgattatcagcgaagtgaacaacagacccagcggcgtgtcccacagattcagcggctctaagtctggcaacaccgccagcctgacaatctctggactgcaagccgaggacgaggccgactacttctgtagcagctacaccagcggcagaaccctgtacgtgttcggcacaggcagcaaagtgacagtgctgggaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2475 - DNA, 3330 bp, Artificial Sequence
  Synthetic Polynucleotide encoding a CAR with optional accessory module(s)
atggccttaccagtgaccgccttgctcctgccgctggccttgctgctccacgccgccaggccggaagtgcagctccagcagtctggacctggcctggttaagcctagccagacactgagcctgacctgtgccatcagcggcgattccatgctgagcaacagcgacacctggaactggatcagacagagccccagcagaggcctggaatggctgggcagaacataccacagaagcacttggtacgacgactacgccagctctgtgcggggcagagtgtccatcaatgtggacaccagcaagaaccagtacagcctgcaactgaacgccgtgacacctgaggataccggcgtgtactactgtgccagagtgcggctccaggacggcaattcttggagcgacgcctttgatgtgtggggccagggcacaatggtcaccgtttctagcggcggaggcggaagtggaggcggaggatctggcggcggaggctctcaatctgctctgacacagcctgccagcgcctctggatctcctggacagagcgtgaccatctcctgtaccggcacctcttctgatgtcggcggctacaactacgtgtcctggtatcagcagcaccccggcaaggcccctaagctgatgatctacgacgtgtccaacagacccagcggcgtgtccaatagattctccggcagcaagagcggcaacaccgccagcctgacaatttctggactgcaagccgaggacgaggccgactactactgtagcagctacaccagcagcagcacactgtacgtgttcggcacaggcacccagctcacagttcttacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2476 - DNA, 3303 bp, Artificial Sequence; identical to SEQ ID NO: 2470
  Synthetic Polynucleotide encoding a CAR with optional accessory module(s)

SEQ ID NO: 2477 - DNA, 3330 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctggaggcggtggaagtggcggcggtggttcaggcggcggaggatctcaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2478 - DNA, 3318 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtccatctacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcctcctttcacattcggccctggcaccaaggtggacatcaaaggcggaggcggaagtggaggcggaggatctggcggcggaggctctcaggtgcagcttgttgaaagcggaggcggagttgtgcagcctggcagaagtctgagactgtcttgtgccgccagcggcttcaccttcagcagctatggaatgcactgggtccgacaggcccctggcaaaggacttgaatgggttgccgtgatctgggacgacggcagcaacaagtattacgtggacagcgtgaagggcagattcaccatcagccgggacaacagcaagaacaccctgtacctccagatgaacagcctgagagccgaggacacagccgtgtattattgcgccagagatgactactacggcagcggctccttcaacagctactatggcacagacgtgtggggccagggcacaacagttaccgttagctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2479 - DNA, 3273 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctgaagtgcaactggttcaatctggcggcggactggttcatccaggcggttctctgagactgagctgtgccggctctggcttcaccttcagcacctacctgatgtactgggtccgacaggcccctggcaagacactggaatgggtgtccgctattggcagcggaggcgatacctactacgccgactctgtgaagggcagattcaccatcagccgggacaacgccaagaacagcctgtacctccagatgaactccctgagagccgaggacatggccgtgtactactgtgccagaggactcggctattggggccagggaacactggtcacagtgtcctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2480 - DNA, 3330 bp, Artificial Sequence
  Synthetic Polynucleotide encoding a CAR with optional accessory module(s)
atggccttaccagtgaccgccttgctcctgccgctggccttgctgctccacgccgccaggccgctgcctgttctgacacagcctccatccgtgtctgtggcccctggaaagaccgccagaatcacatgcggcggcaacaacatcggcagcaagagcgtgcactggtatcagcagaagcctggacaggctcctgtgctggtggtgtacgacgacagcgatagacctagcggcatccccgagagattcagcggcagcaattccggcaataccgccacactgaccatcagcagagtggaagctggcgacgaggccgactactactgccaagtgtgggacagcagcagcgactacgtggtgtttggcggcggaacaaagctgacagtgcttggcggaggcggaagtggaggcggaggatctggcggcggaggctctgaagttcaactggtgcagagcggagccgaagtgaagaagccaggcgagagcctgaagattagctgcaaaggcagcggctacagcttcaccagctactggatcggctgggtccgacagatgcctggcaaaggactggaatggatgggcatcatctaccccggcgacagcgacaccagatacagccctagctttcagggccaagtgaccatctccgccgacaagagcatcagcacagcctacctccagtggtcctctctgaaggccagcgataccgccatgtactactgcgccagacaagtctggggatggcaaggcggcatgtaccccaggtctaactggtggtacaacctggactcttggggccagggcacactggtcacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2481 - DNA, 3300 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctcctagtgtgtctggcgctcctggacagagagtgaccatcagctgtacaggcagcagcagcaatatcggagccggctatgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctctgtgtttggcacaggcacaaaggtgctggtgcttggcggaggcggaagtggaggcggaggatctggcggcggaggctctcaagttcagctggttcagagcggagccgaagtgaagaaacctggcagcagcgtgaaggtgtcctgcaaagcaagcggcggcaccttcagcagctacaccatcaacgtttggagacaggccccaggccagggccttgaatggatgggaggcttcatccctatcagcggcaccgtgaactacgcccagaaattccagggcagagtgacaatcaccgccgacgagagcacaagcaccgcctacatggaactgtccagcctgagaagcgaggacaccgccgtgtactactgtgccagacctctggattggaccgaggacatctggggccagggaacactggtcacagtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2482 - DNA, 3309 bp, Artificial Sequence
  Synthetic Polynucleotide encoding a CAR with optional accessory module(s)
atggccttaccagtgaccgccttgctcctgccgctggccttgctgctccacgccgccaggccgaacttcatgctgacccagcctcacagcgtgtccgagtctccaggcaagaccgtgaccatcagctgtacaggcagcagcggctctatcgccagcaactacgtgcagtggtatcagcagaggccaggcagcgcccctaccatcctgatctacgaggataacaagcggcctagcggcgtgcccgatagattttctggcagcatcgacagcagcagcaacagcgccagcctgacaatcagcggcctgaaaacaggcgacgaggccgactactactgccagagctacgacgacatcaaccactgggttttcggcggaggcaccaagctgacagttcttggaggcggaggcggaagtggaggcggaggatctggcggcggaggctctgaagttcagctggttcagagcggagccgaagtgaagaaacctggggcctctgtgaaggtgtcctgcaaggcttccggctacacctttaccgcctactacctgcactggctgagacaggctccaggccaaggactggaatggatgggctggatgaacaccaacaacggggccaccagatacgcccagaaattccaggacagagtgaccatgaccagagacaccagcatcaacaccgcctacatggaaatgagcggcctgtcctccgacgacaccgccatgtactattgtgccagaggcgacatcagccaggacttcgctgatgtgtggggccagggaacactggtcacagtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2483 - DNA, 3285 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgacacagagccctgccatcatgtccgcttctcccggcgagaaagtgaccatcacatgtagcgccagcagcagcgtgtcctacatgcactggttccagcagaagcccggcacaagccctaagctgtggatctacagcaccagcaatctggcctctggcgtgccagccagattttctggctctggcagcggcaccagctacagcctgacaatcagcagaatggaagccgaggacgccgccacctactactgtcagcagagaagcagctaccctcctacctttggcggaggcaccaagctggaaatcaaaggcggaggcggaagtggaggcggaggatctggcggcggaggctctcaggttcagctccagcagagcggagccgagcttatgaagcctggcgcttccgtgaagatcagctgcaaggccaccggctacaccttcagcagctactggatcgagtgggtcaagcagaggcccggacatggcctggaatggatcggagagatcctgcctggaagcggcagcaccaactacaacgagaagttcaagggcaaagccaccttcaccgccgacaccagcagcaacacagcctatatgcagctgagcagcctgaccagcgaggacagcgccgtgtactactgcgccagatacgactacccttggtttgcctattggggccagggcaccctggttacagtttctgctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2484 - DNA, 3309 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacacagagccctagcagcctgacagtgacagccggcgagaaagtgaccatgagctgcaagagcagccagagcctgctgaacagcggcaaccagaagaactacctgacctggtatcagcagaagcccggccagcctcctaagctgctgatctactgggccagcaccagagaaagcggcgtgcccgatagattcacaggcagcggcagcggaaccgacttcaccctgacaatcagctctgtgcaggccgaggatctggccgtgtactactgccagaacgactacagctaccccttcacctttggctccggcaccaagctggaaatcaaaggcggaggcggaagtggaggcggaggatctggcggcggaggctctcaagttcagctgcaacagcctggggccgaactcgttagacctggcgcttctgtgaagctgtcctgcaaggccagcggctacacctttaccagctactggatcaactgggtcaagcagcggcctggacagggcctcgaatggatcggcaatatctaccccagcgacagctacaccaactacaatcagaagttcaaggacaaggccacactgaccgtggacaagtctagcagcaccgcctacatgcagctgagcagccctacaagcgaggacagcgccgtgtattattgcacccggtcttggcggggcaacagcttcgattattggggccagggcacaaccctgaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2485 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaaggcggaggcggaagtggaggcggaggatctggcggcggaggctctcaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2486 - DNA, 3318 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacacagagccctagcagcctggctatgagcgtgggccagaaagtgaccatgacctgcaagagcagccagagcctgctgaacagcagcaaccagaagaactacctggcctggtatcagcagaagcccggacagtctcctaagctgctggtgtactttgccagcaccagagaaagcggcgtgcccgacagattcatcggctctggaagcggcaccgacttcaccctgacaatcagctctgtgcaggccgaggacctggccgattacttctgtcaccagcactacagcacccctctgacctttggagccggcaccaagctggaactgaaaggcggaggcggaagtggaggcggaggatctggcggcggaggctctgaagttcagctccagcagagcggccctgaccttgtgaaacctggcgcttccgtgaagatgagctgcaaggccagcggctacaccttcaccagctacgtgatgcactgggtcaagcagaaacccggccagggccttgagtggatcggctacatctacccctacaacgatggcaccaagtacaacgagaagttcaagggcaaagccacactgaccagcgacaagtctagcagcaccgcctacatggaactgagcagcctgacctctgaggacagcgccgtgtactactgcgccagagaggaatacggcaactacgtgcggtacttcgacgtgtggggagccggaacaaccgtgacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2487 - DNA, 3300 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggtcacacagcctccatccgtgtctgctgcccctggacagaaagtgaccatcagctgtagcggcagcagcagcaacatcggcaacaactacgtgtcctggtatcagcagctgcccggcacagctcccaaactgctgatctacgacaacaacaagcggcccagcggcatccccgatagattttctgccagcaagagcggcaccagcgccacactgggaatcacaggactccagaccagagatgaggccgactactactgcggcacctgggattcttctctgtccgcctgggttttcggcggaggcacaaaactgacagtgctcggaggcggaggcggaagtggaggcggaggatctggcggcggaggctctcaagttcagctggttcagtctggggccgaagtgaagaaacctggcagcagcgtgaaggtgtcctgcaaggcttccggcgataccttcagcagctactacatcagctgggtccgacaggccccaggacaaggacttgagtggatgggcagaatcatccccatcctgggaatcgccaactacgcccagaaataccagggcagagtgaccctgagcgccgacaagagcacaagcaccagctacatggaactgaacagcctgagcagcgaggacaccgccgtgtactattgtgccctggactggtcctacagcatcgactattggggccagggcaccctggtcacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2488 - DNA, 3318 bp, Artificial Sequence
  Synthetic Polynucleotide encoding a CAR with optional accessory module(s)
atggccttaccagtgaccgccttgctcctgccgctggccttgctgctccacgccgccaggccggaattcgaagtgaagctggtggaatctggcggcggactggttaagtttggcggcagcctgaagctgagctgtgccgcctctggctttaccctgagcagctactacatgagctgggtccgacagagccccgagaagagactggaactggtggccgtgattaacagcaacggcggcagcacctactatcccgacacagtgaagggcagattcaccatcagccgggacaacgccaagaacaccctgtacctccagatgtctagcctgaagtccgaggacacagccctgtactactgcgccagaccattctactacagcaacagccccttcgcctattggggccagggaacactggttacagtgtctgctggcggaggcggaagtggaggcggaggatctggcggcggaggctctgatgttctgatgacccagacacctctgagcctgcctgtgtctctgggcgatcaggccagcatctcctgtagaagcagccagagcatcgtgcacagaaccggcaacacctacctggaatggtatctccagaagcctgggcagagccccaagctgctgatctacaaggtgtccaacagattcagcggcgtgcccgacagattttctggcagcggctctggcaccgacttcaccctgaagattagcagagtgggagccgaggacctgggcgtctactactgctttcaaggcagccacgtgccatacacctttggcggaggcaccaagctggaaatcaagacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2489 - DNA, 3309 bp, Artificial Sequence
  Synthetic Polynucleotide encoding a CAR with optional accessory module(s)
atggccttaccagtgaccgccttgctcctgccgctggccttgctgctccacgccgccaggccggagctggtcatgacacagagccctgcttctctggccgtgtcactgggacagagagccaccatctcttgcagagccagcgagagcgtggacagctacggcaagagcttcatgcactggtatcagctcaagcccggccagcctcctaagctgctgatctacagagcctccaacctggaaagcggcgtgccagccagattttctggcagcggcagcagaaccgacttcaccctgaccattgatcccgtggaagccgatgatgccgccacctactactgccagcagaacaacgaggacccctggacatttggcggaggcaccaagctggaaatcaaaggcggaggcggaagtggaggcggaggatctggcggcggaggctctgaagtgcagctcgaacagtctggccccgagcttgtgaaacctggcgcttccgtgaagatgagctgcaaggccagcggctacaccttcaccaactactacatgaaatgggtcaagcagagccacggcaagtccctggaatggatcggcgatctgaaccccaacaacggcgacaccttctacaaccagaagttcaagggcaaagccacactgaccgtggacaagagcagcaacaccgcctacatgcagctcaactccctgaccagcgaggacagcgccgtgtactactgtgccagaaccggcagatacgaagagaacgctatggactactggggccagggcacaagcgtgacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2490 - DNA, 3291 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2491 - DNA, 3312 bp, Artificial Sequence
  Synthetic Polynucleotide encoding a CAR with optional accessory module(s)
atggccttaccagtgaccgccttgctcctgccgctggccttgctgctccacgccgccaggccggacgtgctgatgacccagacacctgtgtctctgtccgtgtctctgggagatcaggccagcatctcctgtagaagcagccagagcatcgtgcacagcaccggcaacacctacctggaatggtatctccagaagcctggacagagccccaagctgctgatctacaagatcagcaacagattcagcggcgtgcccgacagattttctggcagcggctctggcaccgacttcaccctgaagattagcagagtggaagccgaggacctgggcgtgtactactgcttccaagcctctcacgcccctagaacctttggcggaggcaccaagctggaaatcaagagaggcggaggcggaagtggaggcggaggatctggcggcggaggctctgaagtgatcctggtggaaagcggaggcggccttgtgaaacctggcggatctctgaagctgagctgtgccgccagcggcttcacctttagcagctacacaatgagctgggtccgacagacccctgagaagagactggaatgggtcgccaccatctcttccggcggagggaacacctactatcccgactctgtgaagggcagattcaccatcagccgggacaacgccaagaacaacctgtacctccagatgagcagcctgcggagcgaagatacagccctgtactattgcgcccggtactacagatacgaggcttggtttgcctcttggggccagggcacactggttacagtttctgctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2492 - DNA, 2922 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggaggactggtgcaggctggaagaagcctgagactgtcttgtgccgccagcgagcacacctttagctctcacgtgatgggctggttcagacaggcccctggcaaagaaagggaaagcgtggccgttatcggctggcgggatattagcaccagctacgccgatagcgtgaagggcagattcaccatcagccgggacaacgccaagaaaaccctgtacctccagatgaacagcctgaagccagaggacaccgccgtgtactactgcgccgccagaagaattgacgccgccgactttgattcttggggccagggaacccaagtgaccgtttctagcttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2493 - DNA, 2919 bp, Artificial Sequence
  Synthetic Polynucleotide encoding a CAR with optional accessory module(s)
atggccttaccagtgaccgccttgctcctgccgctggccttgctgctccacgccgccaggccggaagtgcaactggttgaatccggtggcggcctggtgcaagcaggcggatctctcagacttagctgtgccgcctccggcagaaccttcacaatgggatggtttaggcaggctccagggaaagagagagagttcgtcgccgccatctctctgtctcccacactggcctactacgccgagtctgtgaaaggccggttcaccatctccagagataatgccaagaacaccgtggtgctgcaaatgaactctctgaaacccgaggatacagccctgtactattgtgccgctgaccggaagtccgtgatgagcatcagacccgattactggggacagggcacacaagtcacagtgtcctctttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2494 - DNA, 3321 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggaggactggtgcaggctggaagaagcctgagactgtcttgtgccgccagcgagcacacctttagctctcacgtgatgggctggttcagacaggcccctggcaaagaaagggaaagcgtggccgttatcggctggcgggatattagcaccagctacgccgatagcgtgaagggcagattcaccatcagccgggacaacgccaagaaaaccctgtacctccagatgaacagcctgaagccagaggacaccgccgtgtactactgcgccgccagaagaattgacgccgccgactttgattcttggggccagggaacccaagtgaccgtttctagcggaggcggtggaagtggcggcggtggttcaggcggcggaggatctgaagtgcaactggttgaatccggtggcggcctggtgcaagcaggcggatctctcagacttagctgtgccgcctccggcagaaccttcacaatgggatggtttaggcaggctccagggaaagagagagagttcgtcgccgccatctctctgtctcccacactggcctactacgccgagtctgtgaaaggccggttcaccatctccagagataatgccaagaacaccgtggtgctgcaaatgaactctctgaaacccgaggatacagccctgtactattgtgccgctgaccggaagtccgtgatgagcatcagacccgattactggggacagggcacacaagtcacagtgtcctctttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2495 - DNA, 2913 bp, Artificial Sequence
  Synthetic Polynucleotide encoding a CAR with optional accessory module(s)
atggccttaccagtgaccgccttgctcctgccgctggccttgctgctccacgccgccaggccggaggtgcaactggttgagtctggcggaggactggttcaggcaggcggatctctgagactgagctgtatcgccaccggcaaggtgttcagcatctacgacatgggctggtacagacaggcccctggcaagcagagagagctggttgccgagatcacaagcagcggcaccacacactacgacgacttcgtgtccggcagattcaccatcagccgggacaacgccaagaacaccgtgtacctccagatgaacaccctgaaggccgaggacaccgccgtgtactactgtagagccaaccacgtgttcggcggcagctattggggacagggaacccaagtgacagtgtctagtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2496 - DNA, 2931 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagcttgttgaaagcggaggtggcctggttcaacctggcggaagcctgagactgtcctgtgaagccagcggctttaccctggactactacgccatcggctggtttagacaagctcccggcaaagagagagagggcgtcatctgcatcagcagatccgacggcagcacctactatgccgacagcgtgaagggacgcttcaccatctccagagacaatgccaaaaagacggtctacctgcaaatgatctccctcaagcctgaggataccgccgcctactattgtgccgctggcgctgattgcagcggctacctgagagactacgagttcagaggccagggcacacaagtgaccgtcagctctttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2497 - DNA, 3300 bp, Artificial Sequence
  Synthetic Polynucleotide encoding a CAR with optional accessory module(s)
atggccttaccagtgaccgccttgctcctgccgctggccttgctgctccacgccgccaggccggaggtgcaactggttgagtctggcggaggactggttcaggcaggcggatctctgagactgagctgtatcgccaccggcaaggtgttcagcatctacgacatgggctggtacagacaggcccctggcaagcagagagagctggttgccgagatcacaagcagcggcaccacacactacgacgacttcgtgtccggcagattcaccatcagccgggacaacgccaagaacaccgtgtacctccagatgaacaccctgaaggccgaggacaccgccgtgtactactgtagagccaaccacgtgttcggcggcagctattggggacagggaacccaagtgacagtgtctagtgaggtggccgctttggagaaacaggtgcagcttgttgaaagcggaggtggcctggttcaacctggcggaagcctgagactgtcctgtgaagccagcggctttaccctggactactacgccatcggctggtttagacaagctcccggcaaagagagagagggcgtcatctgcatcagcagatccgacggcagcacctactatgccgacagcgtgaagggacgcttcaccatctccagagacaatgccaaaaagacggtctacctgcaaatgatctccctcaagcctgaggataccgccgcctactattgtgccgctggcgctgattgcagcggctacctgagagactacgagttcagaggccagggcacacaagtgaccgtcagctctttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2498 - DNA, 2949 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggcagactggtgcagcctagaggaagcctgagactgtcttgtgccggcagcggcagaacctttagcacatacggcatggcctggttcagacaggcccctggaaaagagagagagttcgtcgccagcaaggccagcatgaactactccggcaggacctactacgccgacagcgtgaagggcagattcacaatcgccagagacaacgccaagaacatggtgttcctccagatgaacaatctgaagcccgaggacaccgccgtgtactattgtgccgctggcacaggctgtagcacctacggctgtttcgacgcccagatcatcgactactggggcaagggcacactggtcacagtttctagcttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2499 - DNA, 2922 bp, Artificial Sequence
  Synthetic Polynucleotide encoding a CAR with optional accessory module(s)
atggccttaccagtgaccgccttgctcctgccgctggccttgctgctccacgccgccaggccgcaagtcaaactggaagaaagcggtggcggcctggtgcaacctggcgaatctctgagactgagctgtagcgccagcggctccatcttcaaggtgttcagagtgttcgccatgagctggtacaggcaaggccctggcaagcagagagagctggtcgcctctatcagcagcggcgagacaaccacatacgccgactctgtgaaaggccggttcaccatcagccgggataatgccaagaataccgcctatctccagatggactccctgaagcctgaagatacagctgtgtactactgcaacgccgaccataccttcaccggcgatttttggggccagggaacccaagtgaccgtgtctagtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2500 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggcagactggtgcagcctagaggaagcctgagactgtcttgtgccggcagcggcagaacctttagcacatacggcatggcctggttcagacaggcccctggaaaagagagagagttcgtcgccagcaaggccagcatgaactactccggcaggacctactacgccgacagcgtgaagggcagattcacaatcgccagagacaacgccaagaacatggtgttcctccagatgaacaatctgaagcccgaggacaccgccgtgtactattgtgccgctggcacaggctgtagcacctacggctgtttcgacgcccagatcatcgactactggggcaagggcacactggtcacagtttctagcgaggtggccgctttggagaaacaagtcaaactggaagaaagcggtggcggcctggtgcaacctggcgaatctctgagactgagctgtagcgccagcggctccatcttcaaggtgttcagagtgttcgccatgagctggtacaggcaaggccctggcaagcagagagagctggtcgcctctatcagcagcggcgagacaaccacatacgccgactctgtgaaaggccggttcaccatcagccgggataatgccaagaataccgcctatctccagatggactccctgaagcctgaagatacagctgtgtactactgcaacgccgaccataccttcaccggcgatttttggggccagggaacccaagtgaccgtgtctagtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2501 - DNA, 2916 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggagagctggttcaacctggcggacctctgagactgtcttgtgccgccagcggcaacatcttcagcatcaaccggatgggctggtacagacaggcccctggaaaacagagagccttcgtcgcctctatcaccgtgcggggcatcaccaattacgccgactctgtgaagggcagattcaccatcagcgtggacaagagcaagaacaccatctacctccagatgaacgccctgaagcctgaggacaccgccgtgtactactgcaatgccgtgtccagcaacagggaccccgattattggggccagggcacccaagtgacagtgtctagtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2502 - DNA, 2952 bp, Artificial Sequence
  Synthetic Polynucleotide encoding a CAR with optional accessory module(s)
atggccttaccagtgaccgccttgctcctgccgctggccttgctgctccacgccgccaggccgcctgttcaactggttgaatctggcggcggactggtgcaggctggcgatagtctcagactgagctgtgccgcctccggcagaacatttggcatcggcacaatgggatggttccggcagcctcctggaaaagaacgcgaatttgtggccgccatcagatggtctacaggcggcaccagatacgccgacagcgtgaaaggccggtttaccatcagcagagacaacgccaagctgaccgtggatctccagatggatagcctgaaaccagaggatacagccgtctattactgcgccgctgacaggctgagcctggatctgtctggcagataccactacaaccctgccgtgtacgactactggggacagggaacacaagtcaccgtgtcctctttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2503 - DNA, 3348 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggagagctggttcaacctggcggacctctgagactgtcttgtgccgccagcggcaacatcttcagcatcaaccggatgggctggtacagacaggcccctggaaaacagagagccttcgtcgcctctatcaccgtgcggggcatcaccaattacgccgactctgtgaagggcagattcaccatcagcgtggacaagagcaagaacaccatctacctccagatgaacgccctgaagcctgaggacaccgccgtgtactactgcaatgccgtgtccagcaacagggaccccgattattggggccagggcacccaagtgacagtgtctagtggaggcggtggaagtggcggcggtggttcaggcggcggaggatctcctgttcaactggttgaatctggcggcggactggtgcaggctggcgatagtctcagactgagctgtgccgcctccggcagaacatttggcatcggcacaatgggatggttccggcagcctcctggaaaagaacgcgaatttgtggccgccatcagatggtctacaggcggcaccagatacgccgacagcgtgaaaggccggtttaccatcagcagagacaacgccaagctgaccgtggatctccagatggatagcctgaaaccagaggatacagccgtctattactgcgccgctgacaggctgagcctggatctgtctggcagataccactacaaccctgccgtgtacgactactggggacagggaacacaagtcaccgtgtcctctttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2504 - DNA, 2922 bp, Artificial Sequence
  Synthetic Polynucleotide encoding a CAR with optional accessory module(s)
atggccttaccagtgaccgccttgctcctgccgctggccttgctgctccacgccgccaggccggccgtgcaactggttgaatctggcggaggactggtgcaggctggcgattctctgagactgacctgtacagccagcggcagagccttcagcacctacttcatggcctggttcagacaggcccctggcaaagagagagagttcgtcgccggaatcgcttggagcggaggctctacagcctacgccgattctgtgaagggcagattcaccatcagccgggacaacgccaagaacaccgtgtacctccagatgaacagcctgaagtccgaggacaccgccgtgtactactgtgccagcagaggcatcgaggtggaagagtttggagcctggggccagggaacccaagtgacagtttcttctttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2505 - DNA, 2925 bp, Artificial Sequence
  Synthetic Polynucleotide encoding a CAR with optional accessory module(s)
atggccttaccagtgaccgccttgctcctgccgctggccttgctgctccacgccgccaggccgcaggttcaactggtggaaagtggcggtggcttggtgcaagcaggcggctctcttagactgtcttgtgctgcctctggcggcaccctgagcaagaataccgtggcatggtttaggcaggctcccggaaaagagcggggctttgtcgccagcatcacctgggatggcagaaccacctactacgccgacagcgtgaaaggccggttcaccatctccagagataatgccaagaatacggtctacttgcaaatgaactccctgaagcctgaagatacagccgtgtacgtgtgcgccgatctcggcaaatggcctgctggacctgccgattattggggacagggcacacaagtcaccgtgtcctctttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2506 - DNA, 3303 bp, Artificial Sequence
  Synthetic Polynucleotide encoding a CAR with optional accessory module(s)
atggccttaccagtgaccgccttgctcctgccgctggccttgctgctccacgccgccaggccggccgtgcaactggttgaatctggcggaggactggtgcaggctggcgattctctgagactgacctgtacagccagcggcagagccttcagcacctacttcatggcctggttcagacaggcccctggcaaagagagagagttcgtcgccggaatcgcttggagcggaggctctacagcctacgccgattctgtgaagggcagattcaccatcagccgggacaacgccaagaacaccgtgtacctccagatgaacagcctgaagtccgaggacaccgccgtgtactactgtgccagcagaggcatcgaggtggaagagtttggagcctggggccagggaacccaagtgacagtttcttctcctggcggaggcgggtctcctcaggttcaactggtggaaagtggcggtggcttggtgcaagcaggcggctctcttagactgtcttgtgctgcctctggcggcaccctgagcaagaataccgtggcatggtttaggcaggctcccggaaaagagcggggctttgtcgccagcatcacctgggatggcagaaccacctactacgccgacagcgtgaaaggccggttcaccatctccagagataatgccaagaatacggtctacttgcaaatgaactccctgaagcctgaagatacagccgtgtacgtgtgcgccgatctcggcaaatggcctgctggacctgccgattattggggacagggcacacaagtcaccgtgtcctctttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2507 - DNA, 3387 bp, Artificial Sequence
  Synthetic Polynucleotide encoding a CAR with optional accessory module(s)
atggccttaccagtgaccgccttgctcctgccgctggccttgctgctccacgccgccaggccggccgtgcaactggttgaatctggcggaggactggtgcaggctggcgattctctgagactgacctgtacagccagcggcagagccttcagcacctacttcatggcctggttcagacaggcccctggcaaagagagagagttcgtcgccggaatcgcttggagcggaggctctacagcctacgccgattctgtgaagggcagattcaccatcagccgggacaacgccaagaacaccgtgtacctccagatgaacagcctgaagtccgaggacaccgccgtgtactactgtgccagcagaggcatcgaggtggaagagtttggagcctggggccagggaacccaagtgacagtttcttctcctggcggaggcgggtctcctcaggttcaactggtggaaagtggcggtggcttggtgcaagcaggcggctctcttagactgtcttgtgctgcctctggcggcaccctgagcaagaataccgtggcatggtttaggcaggctcccggaaaagagcggggctttgtcgccagcatcacctgggatggcagaaccacctactacgccgacagcgtgaaaggccggttcaccatctccagagataatgccaagaatacggtctacttgcaaatgaactccctgaagcctgaagatacagccgtgtacgtgtgcgccgatctcggcaaatggcctgctggacctgccgattattggggacagggcacacaagtcaccgtgtcctctgaggttgccgcactggagaaggaagtagccgcgcttgagaaagaggtggcagcgctggagaaagaagttgccgccttggaaaaattcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2508 - DNA, 3309 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagcgccagcagcagcgtgtcctacatgtactggtatcagcagaagcccggacaggcccctagactgctgatctacagaaccagcaacctggcctctggcatccccgccagattttctggctctggcagcggcaccgatttcaccctgaccataagcagcctggaacctgaggacttcgccgtgtactactgccagcagtaccacagctaccccaccacctttggacagggcaccaaggtggaaatcaagcggacagttggcggaggcggaagtggaggcggaggatctggcggcggaggctctgaagtgcagctggttgaatcaggtggcggcctggttcaacctggcggatctctgagactgtcttgtgccgccagcggcttcagcttcaacacctacgccatgaactgggtccgacaggctcctggcaaaggactggaatgggtgtcccacatcagaagcaagagcaacaacttcgccacctactacgccgacagcgtgaaggacagattcaccatcagccgggacaacgccaagaacagcctgtacctccagatgaactccctgagagccgaggacaccgccgtgtattattgcgccagacaaggcggcgacttccctatggattattggggccagggcaccctggtcaccgtttcttctacgcgtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2509 - DNA, 3291 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaaggcggaggcggaagtggaggcggaggatctggcggcggaggctctcaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2510 - DNA, 3306 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagaggcggaggcggaagtggaggcggaggatctggcggcggaggctctgaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2511 - DNA, 3300 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagaggcggaggcggaagtggaggcggaggatctggcggcggaggctctgaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2512 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcacgcgtacagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2513 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactacaacagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2514 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactaccaaagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2515 - DNA, 3330 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2516 - DNA, 3351 bp, Artificial Sequence
  Synthetic Polynucleotide encoding a CAR with optional accessory module(s)
atggccctgcctgtgacagctctgctgctgcctctggcactgctgctgcacgccgccagacctgacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaagggaggcggaggaagtggcggcggaggatctgggggaggcggaagccaggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2517 - DNA, 3348 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccaggccgctcccagcatccctgtgacacctggcgagagcgtgtccatctcctgccggtctagcaagagcctgctgaacagcaacggcaatacctacctgtactggttcctccagcggccaggccagtctccccaactgctgatctaccggatgagcaacctggcctccggcgtgcccgatagattttctggcagcggctccggcaccgccttcaccctgagaatcagcagagtggaagccgaggacgtgggcgtgtactactgtatgcagcacctggaataccccttcaccttcggagccggcaccaagctggaactgaagagaggcggaggcggaagtggaggcggaggatctggcggcggaggctctgaagtgcaactccagcagagcggccctgagctgattaagcctggggccagcgtgaagatgagctgcaaggccagcggctacaccttcaccagctacgtgatgcactgggtcaagcagaagcccggccagggcctggaatggatcggctacatcaacccctacaacgatggcaccaagtacaacgagaagttcaagggcaaggccaccctgaccagcgacaagagcagcagcaccgcctacatggaactgagcagcctgacaagcgaggacagcgccgtgtactattgcgccagaggcacctactactacggcagccgggtgttcgactattggggccagggcaccacactgaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2518 - DNA, 3342 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccccgatttccagagcgtgacccctaaagaaaaagtgaccatcacctgtcgggccagcgagagcgtggacacattcggcatcagcttcatgaactggttccagcagaagcccgatcagagccccaagctgctgattcacgccgccagcaatcaaggcagcggagtgcctagcagattttccggctctggcagcggcaccgatttcaccctgaccatcaatagcctggaagccgaggatgccgccacctactactgccagcagagcaaagaggtgcccttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcagctcttggatgaactgggtccgacaggcccctggcaaaggactggaatgggtcggaagaatctaccccggcgacggcgacaccaactacaacggcaagttcaagggcagattcaccatcagccgggacgacagcaagaacagcctgtacctgcagatgaactccctgaaaaccgaggacaccgccgtgtactactgtgccagatccggcttcatcaccaccgtgctggacttcgattattggggccagggcaccctggtcaccgtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2519 - DNA, 3330 bp, Artificial Sequence
  Synthetic Polynucleotide encoding a CAR with optional accessory module(s)
atggccttaccagtgaccgccttgctcctgccgctggccttgctgctccacgccgccaggccggccattcagctcacacagagcccttctagcctgagcgcctctgtgggcgacagagtgaccatcacatgtagagccagccagggcatcagcagcgcccagcagaaacctggaaaggcccctaagctgctgatcctggcctggtacagcagcctggaaagcggagtgcctagcagattcagcggctacgatgcctctggcagcggcaccgatttcaccctgacaatatccagcctccagcctgaggacttcgccacctactactgccagcagttcaacagctacccctacaccttcggccagggcaccaagctggaaatcaaaggcggaggcggaagtggaggcggaggatctggcggcggaggctctgaagtgcaactggttcagagcggagccgaagtgaagaagcctggcgagagcctgaagattagctgcaaaggctccggctacagcttcagcagctcttggatcggctgggtccgacagatgcctggcaaaggactggaatggatgggcatcatctaccccgacgacagcgacaccagatacagccctagcttccagggccaagtgacaatcagcgccgacaagagcatcagaaccgcctacctccagtggtcctctctgaaggccagcgataccgccatgtactactgcgccagacacgtgaccatgatctggggagtgattatcgacttctggggccagggaaccctggtcacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2520 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccgatcaacatctacaacgccgagcctgccaatcctagcgagaagaacagccccgaattcgacatcgtgatgacacagagccccgccacactgtcactgtctccaggcgaaagagccacactgagctgtcggagcagcaagagcctccagaacgtgaacggcaacacctacctgtactggttccagcagaagcccggccagtctcctcagctcctgatctacagaatgagcaacctgaacagcggcgtgcccgacagattttctggcagcggaagcggcaccgagttcaccctgaccataagcagcctggaacctgaggacttcgccgtgtactactgtatgcagcacctggaataccccatcaccttcggagccggcaccaagctggaaatcaaaggcggaggcggaagtggaggcggaggatctggcggcggaggctctgaagtgcaactggttgaatctggcggcggactggttaagcctggcggatctctgaagctgagctgtgccgccagcggctacacctttaccagctacgtgatgcactgggtccgacaggcccctggcaaaggacttgagtggatcggctacatcaacccctacaacgatggcaccaagtacaacgagaagttccagggcagagtgaccatcagctccgacaagagcatcagcaccgcctacatggaactgagcagcctgagaagcgaggataccgccatgtactattgcgccagaggcacctactactacggcaccagagtgttcgactactggggccagggaaccctggtcacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2521 - DNA, 3348 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacacagtctcccgccacactgtcactgtctccaggcgaaagagccacactgagctgtagagccagccagagcgtggactacgacggcgacagctacctgaactggtatcagcagaagcccggccagcctcctaagctgctgatctacgatgccagcaacctggtgtctggcatccctcctagattttccggcagcggctctggcaccgatttcaccctgaccatcagcagactggaacccgaggacttcgccgtgtaccactgtcagcagagcacagaggacccctggacatttggcggaggcaccaagctggaaatcaaaggcggaggcggaagtggaggcggaggatctggcggcggaggctctcaggtgcagctggttgaatctggcggcggacttgttgagcctggcggatctctgagactgagctgcatgagcggctacgccttcagcagctactggatgaactgggtccgacagatgcccggcaaaggactggaatggatgggccagatttggcctggcgacggcgataccaactacaaccccagcctgaagtccagagtgaccatcaccgccgatgagagcaccagcaccgcctacatggaactgtctagcctgaaggccgaggatacagccgtgtacttctgcgccagacgggaaaccacaaccgtgggcagatattactacgctatggactactggggccagggcaccctggttacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2522 - DNA, 3339 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacacagtctcccgccacactgtcactgtctccaggcgaaagagccacactgagctgtagagccagccagagcgtggacaactacggcatcagcttcatgaactggtatcagcagaagcccggccagcctcctaagctgctgatctacgccgccagcaatcaaggctctggcatccccagcagattttccggctctggaagcggcaccgacttcaccctgaccataagcagcctggaacctgaggacttcgccatgtacttttgccagcagagcaacgaggtgcccagaacctttggcggaggcaccaagctggaaatcaaaggcggaggcggaagtggaggcggaggatctggcggcggaggctctcaggtgcaactggttgagtctggcggcggacttgttgaacctggcggaagcctgagactgagctgcatgagcggctacgcctttagcagctcctggatgaactgggtccgacagatgcctggcaaaggactggaatggatgggcagaatctaccccggcgacggcgacaccaactacaacggcaagttcaaagaacgggtcaccatcaccgccgacgagagcacaagcaccgcctacatggaactgagcagcctgaaggccgaggataccgccgtgtacttctgcgccagaagcgagtattggggcaactactgggctatggactactggggccagggcacactggtcacagtgtctagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2523 - DNA, 3336 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacacagtctcccgccacactgtcactgtctccaggcgaaagagccacactgagctgcaaggccagtcagaacgtgggcacaaacgtggcctggtatcagcagaagcctggacagcctcctaagctgctgatctacagcgccacctaccggaactctggcatccctgccagattttctggcagcggctctggcaccgagttcaccctgaccatcaccaacgtgcagagcaaggacctggccgactacttctacttctgccagtacaacagatacccctacaccagcggcggaggcaccaagctggaaatcaaaagaggcggaggcggaagtggaggcggaggatctggcggcggaggctctcaggtgcaactggttgaatcaggcggaggactggtggaacctggcggatctctgagactgagctgtatgagcggctacgccttcagcagctactggatgaactgggtccgacagatgcccggcaaaggactggaatggatgggccaaatctaccccggcgacggcgacaccaactacaacggcaagttcaagggcagagtgacaatcaccgccgacgagagcacaagcaccgcctacatggaactgagcagcctgaaggccgaggataccgccgtgtacttctgcgccagaaagaccatcagcagcgtggtggatttctacttcgacaactggggccagggcaccctggtcacagtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2524 - DNA, 3375 bp, Artificial Sequence
  Synthetic Polynucleotide encoding a CAR with optional accessory module(s)
atggccttaccagtgaccgccttgctcctgccgctggccttgctgctccacgccgccaggccgatcaacatctacaacgccgagcctgccaatcctagcgagaagaacagccccgaattccagatcgtgctgacacagtctccagccacactgagcgcttctccaggcgagaaggccaccatgacatgttctgccagcagcggcgtgaactacatgcactggtatcagcagaagcccggcacaagccccaagcggtggatctacgataccgacaagacagccagcggagtgcccgccagattttctggctctggcagcggcacatcctacagcctgacaatcagcagcatggaagccgaggatgccgccacctactactgtcaccagagaggcagctacaccttcggcggaggcaccaagctggaaatcaaaggcggaggcggaagtggaggcggaggatctggcggcggaggctctcaagttcagctggaacaacctggcgctgaggtggtcaaaccaggggcctctgtgaaggtgtcctgcaagacaagcggctacacattcaccagcaactggatgcactgggtcaagcagacccctggcaaaggactggaatggatcggcgagatcgaccccagcgactcctacaccaactacaaccagaagttcgacggcaaggccaagctgaccgtggacaagtctagcagcaccgcctacatggaagtgtccgatctgaccgccgaagatagcgccacatattactgcgccagaggcagcaacccctactactacgctatggactattggggccagggcaccagcgtgacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2525 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2526 - DNA, 3357 bp, Artificial Sequence
  Synthetic Polynucleotide encoding a CAR with optional accessory module(s)
atggccttaccagtgaccgccttgctcctgccgctggccttgctgctccacgccgccaggccggacgacatccagctgacccagagccccagcagcctgagcgccagcgtgggcgacagagtgaccatcacctgcaaggccagccagagcgtggactacgacggcgacagctacctgaactggtaccagcagatccccggcaaggcccccaagctgctgatctacgacgccagcaacctggtgagcggcatcccccccagattcagcggcagcggcagcggcaccgactacaccttcaccatcagcagcctgcagcccgaggacatcgccacctaccactgccagcagagcaccgaggacccctggaccttcggcggcggcaccaagctgcagatcaagagaggcggaggcggaagtggaggcggaggatctggcggcggaggctctcaggtgcagctgcagcagagcggcgccgaggtgaagaagcccggcagcagcgtgaaggtgagctgcaaggccagcggctacgccttcagcagctactggatgaactgggtgagacagagacccggccagggcctggagtggatcggccagatttggcccggcgacggcgacaccaactacaacggcaagttcaagggcagagccaccatcaccgccgacgagagcaccaacaccgcctacatggagctgagcagcctgagaagcgaggacaccgccttctacagctgcgccagaagagagaccaccaccgtgggcagatactactacgctatggactactggggccagggcaccaccgtgaccgtgagcagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2527 - DNA, 3330 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctgcctctgtgtctggctctcctggccagagcatcaccatcagctgtaccggcaccagctctgatgtcggcggctacaattacgtgtcctggtatcagcagcaccccggcaaggcccctaagctgatgatctacgacgtgaacaacagacccagcgaggtgtccaacagattcagcggcagcaagagcggcaataccgccagcctgacaatctctggactgcaagccgaggacgaggccgactactactgtagcagctacaccacaggcagcagagccgtttttggcggaggcaccaaactgacagtgcttggaggcggaggcggaagtggaggcggaggatctggcggcggaggctctgaagttcagctggttcagtctggcgccgaagtgaagaagcctggcgagtctctgaccatctcctgcaaggccagcggctacagcttccccaactactggatcacctgggtccgacagatgtccggtggtggccttgagtggatgggcagaatcgatcccggcgactcctacaccacctacaatcctagcttccagggccacgtgaccatcagcatcgacaagagcaccaacaccgcctacctgcactggaacagcctgaaagccagcgacaccgccatgtactactgcgcccggtactatgtgtccctggtggacatttggggccagggcacactggtcacagtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2528 - DNA, 3348 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggtcacacagcctccatccgtgtctgctgcccctggacagaaagtgaccatctcctgtagcggcagcagcagcaacatcggcaacaactacgtgtcctggtatcagcagctccccggcacagctcccaaactgctgatctacgacaacaacaagcggcccagcggcatccccgatagattttctggcagcaagagcggcaccagcgccacactgggaattaccggacttcagacaggcgacgaggccgactactactgtggcacatgggatggcagcctgtacaccatgcttttcggcggaggcaccaagctgacagtgcttggcggaggcggaagtggaggcggaggatctggcggcggaggctctgaagtgcaactggtggaatctggcggcggactggttaagcctggcggatctctgagactgtcttgtgccgccagcggcttcaccttcagcaatgcctggatgagctgggttcgacaggcccctggaaaaggactggaatgggtcggattcatccggtccaaagcctacggcggcaccacagaatatgccgcctctgtgaagggcagattcaccatcagccgggacgacagcaagtctatcgcctacctccagatgaacaacctgaaaaccgaggacaccgccgtgtactactgcgccagagatggcctgtacagcagctcttggtacgacagcgattactggggccagggcacactggtcacagtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2529 - DNA, 3363 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctcctagtgtgtctggcgctcctggacagagagtgaccatctcttgtaccggcagcagcagcaatatcggagccggctatgacgtgcactggtatcagcagctccctggcacagcccctaaactgctgatcttcggcaacagcaacagacccagcggcgtgcccgatagattcagcggctttaagagcggcacaagcgccagcctggctatcactggactgcaagccgaggacgaggccgactacttctgccagagctacgatagcagcctgagcggcagcggagtgtttggcacaggcaccaaagtgacagtgcttggcggcggaggcggaagtggaggcggaggatctggcggcggaggctctcaaatgcaactggttcaaagcggcggtggcctggtgcaacctggaagaagtctgagactgagctgtgccgccagcggcttcaccttcgatgattacgccatgcactgggtccgacaggcccctggaaaaggactggaatgggtgtccggcatctcctggaatagcggctctatcggctacgccgacagcgtgaagggcagattcaccatcagccgggacaacgccaagaacagcctgtacctccagatgaactccctgagagccgaggatacagccctgtactactgcgccaaggacatccacagcggcagctactacggcctgctgtactacgctatggacgtgtggggccagggcacaaccgtgacagtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2530 - DNA, 3324 bp, Artificial Sequence
  Synthetic Polynucleotide encoding a CAR with optional accessory module(s)
atggccttaccagtgaccgccttgctcctgccgctggccttgctgctccacgccgccaggccggactacatccacgtgacacagagccctagcagcctgtccgtgtccatcggcgatagagtgaccatcaactgccagacctctcaaggcgtgggcagcgacctgcactggtatcagcacaaacctggcagagcccctaagctgctgatccaccatgccagctctgtggaagatggcgtgcccagcagattttccggcaccggatttcacaccagcttcaacctgacaatcaacgacctccaggccgacgacatcggcacctactactgtcaagtgctccagagcttcggcagaggcagcagactggatacaaaaggcggaggcggaagtggaggcggaggatctggcggcggaggctctagggcacacctggtgcagtctggcaccgccatgaagaaacctggcgcttccgtcagagtgtcctgtcagacaagcggctacaccttcacagcccacatcctgttctggttcagacaggccccaggcagaggactggaatgggtcggatggatcaagccccagtacggggccgtgaatttcggcggaggcttcagagacagagtgaccctgaccagggacgtgtaccgggaaatcgcctacatggacatccggggcctgaagcctgatgacaccgccgtgtactactgcgccagggatagaagctacggcgacagctcttgggctctcgatgcttggggacagggcacaacagtggtggtgtctgctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2531 - DNA, 3354 bp, Artificial Sequence
  Synthetic Polynucleotide encoding a CAR with optional accessory module(s)
atggccttaccagtgaccgccttgctcctgccgctggccttgctgctccacgccgccaggccggacgtgcagatgatccagacccccgatagcctggccgtgtccctgggacagagagccaccatctcttgcagagccagcgagagcgtggacaactacggcatcagcttcatgcactggtatcagcagaagcccggccagagccccaagctgctgatctacagagcctccaacctggaaagcggcatccccgccagattttccggcagcggcagcagaaccgacttcaccctgaccatcaaccccgtggaaaccgacgacgtggcaacctactactgccagcagaacaacaaggacccccccacctttggcggaggcaccaagctggaaatcaagggcggaggcggaagtggaggcggaggatctggcggcggaggctctgggggaggcggctctcaggtgcaactccagcagtctggcgctgagcttgtgaagcctggggccagcgtgaagattagctgcaaggccagcggctacgccttcagcagctactggatgaactgggtcaagcagcggcctggcaagggcctggaatggatcggccaaatctaccccggcgacggcgacaccacctacaacggcaagttcaagggcaaggccaccctgacagccgacaagagcagcagcaccgtgtacatgcaactgaacagcctgaccagcgaggacagcgccgtgtacttctgcgtgcggtactactacggcagctccggctacttcgactattggggccagggcaccacactgaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2532 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggacgtgcagatgatccagacccccagcagcctgtctgccagcctgggcgatagagtgaccatcagctgtcgggccagccaggacatcggcaactacctgaactggtatcagcagaaacccgacggcaccgtgaagctgctgatctactacaccagcagactgcacagcggcgtgcccagcagattttctggcagcggctctggcaccgagtacagcctgaccatctccaacctggaacaggaagatattgctacctacttctgtcagcaaggcagcgccctgccccctacatttggcggcggaacaaagctggaaatcaacggcggaggcggaagtggaggcggaggatctggcggcggaggctctgctctccagctccagcagtctggcgcagaactcgtgcggcctggcgcttctgtgaccctgagctgtaaagccagcggctacaccttcaccgactacgagatgcactgggtcaagcagacccctgtgcacggcctggaatggatcggagccatcgaccctgagacaggcggcaccgcctacaaccagaagttcgagggcaaggccatcctgaccgccgacaagagcagcagcacagcctacatggaactgcggagcctgacctccgaggacagccccgtgtactactgtgccagacggcggtactacggcagcagctccttcgactattggggccagggcaccaccctgaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2533 - DNA, 3348 bp, Artificial Sequence
  Synthetic Polynucleotide encoding a CAR with optional accessory module(s)
atgaggctccctgctcagctcctggggctgctaatgctctgggtctctggaagcagtggggatgttgtgatgactcagtctccactctccctgcccgtcacccctggagcgccggcctccatctcctgcagatccagtcagagcattgtacatagtaatggaaacacctatttagagtggtatcttcaaaagccagggcagtctccaaagctcctgatctataaagtttccaaccgattttctggagtccctgacaggttcagtggaagtggatcaggcacagattttacactgagaatcagcagagtggaggctgaggatgttggaatttattactgctttcaaggttcacatgttcctccgacgttcggccctgggaccaaattggaaatcaaaggcggaggcggaagtggaggcggaggatctggcggcggaggctctgaagtgcagctggtggagtctgggggaggcttggtccagcctggggggtccctgagactctcctgttcagcctctggattcacctttagtagctttggaatgcactgggtccgccaggctccagggaaggggctggaatgggtggcctacattagtagtggcagtagtaccatctactatggagacaccgtgaagggccgattcaccatctccagagacaacgccaagaactcactgtttctgcaaatgagcagcctgagagccgaggacacggccgtgtattattgtgcgagagaggggggatattactacggaaggagttactatactatggactactggggccaagggaccacggtcaccgtctccacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2534 - DNA, 3423 bp, Artificial Sequence
  Synthetic Polynucleotide encoding a CAR with optional accessory module(s)
atggccttaccagtgaccgccttgctcctgccgctggccttgctgctccacgccgccaggccggccagaaagagaacccagcccaccttcggcttcaccgtgaactggaagttcagcgagagcaccaccgtgttcaccggccagtgcttcatcgaccggaacggcaaagaggtgctgaaaaccatgtggctgctgcggagcagcgtgaacgacatcggcgacgactggaaggccaccagagtgggcatcaacatcttcacccggctgcggacacagaaagagggcggctctggcggaagcgccagaaagtgtagcctgaccggcaagtggaccaacgacctgggcagcaacatgaccatcggagccgtgaacagcagaggcgagtttaccggcacctacatcaccgccgtgaccgccaccagcaacgagatcaaagagagccccctgcacggcacccagaacaccatcaacaagagcggcggcagcacaacagtgtttacaggacagtgctttattgaccgcaatgggaaagaagtgctgaaaacaatgtggctgctgaggtcctccgtgaatgacattggagatgattggaaagctacaagagtggggattaacatttttaccagactgaggacccagaaagaagggggcagcggaggctccgccagaaaatgctctctgacagggaagtggacaaatgatctggggtccaatatgacaatcggcgctgtgaactctcggggcgagttcactggaacatatattacagccgtgacagctacctctaacgaaatcaaagagtctcctctgcacgggacacagaataccattaacaaacggacccagcctacatttgggtttacagtgaattggaaattctccgagacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2535 - DNA, 3339 bp, Artificial Sequence
  Synthetic Polynucleotide encoding a CAR with optional accessory module(s)
atggccttaccagtgaccgccttgctcctgccgctggccttgctgctccacgccgccaggccggacatcgtcctgacccagtccccagccagcctggcggtgtccctgggtcaacgagctaccatttcctgcagagcctctaagtccgtatccacttccggctatagttacctgcattggtaccaacagaaaccagggcagccacccaagctgctcatctatctggcctcaaacctggagtccggcgtgcccgccagattctccggaagtgggagcggcaccgactttacattgaacatccacccagtcgaagaggaagatgctgccacttattactgtcagcactccagggagctgccatttacatttggctctggcacaaaactggagatcaaaggcggaggcggaagtggaggcggaggatctggcggcggaggctctcaggttcagctggtcgagtccgggggaggtctggtacagccgggtggcagcctcaagctgtcatgtgccgcatctggttttgactttagcaggtattggatgagctgggtccgccaggccccgggcaagggacttgagtggattggagaaataaaccctacttccagcacaatcaacttcacaccttctttgaaagataaggtttttatctctcgggataacgctaaaaacacactgtacttgcagatgtctaaggtgcgaagcgaagacaccgccctctattattgcgcccggggtaattactaccgctatggggatgcgatggactattgggggcaaggtacctccgtcacggtctcaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2536 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccctagctcactgagcgccagcgtgggcgacagggtgaccattacctgctccgccagccaggacatcagcaactacctgaactggtaccagcagaagcccggcaaggcccccaagctgctgatctactacacctccaacctgcactccggcgtgcccagcaggttcagcggaagcggcagcggcaccgatttcaccctgaccatctccagcctgcagcccgaggacttcgccacctactactgccagcagtacaggaagctcccctggactttcggccagggcaccaaactggagatcaagcgtggcggaggcggaagtggaggcggaggatctggcggcggaggctctcaggtgcagctggtccagagcggcgccgaagtgaagaagcccggcagctccgtgaaagtgagctgcaaggccagcggcggcaccttcagcaactactggatgcactgggtgaggcaggcccccggacagggcctggagtggatgggcgccacctacaggggccacagcgacacctactacaaccagaagttcaagggccgggtgaccatcaccgccgacaagagcaccagcaccgcctacatggaactgagcagcctcaggagcgaggacaccgctgtgtattactgcgccaggggcgccatctacgacggctacgacgtgctggacaactggggccagggcacactggtgaccgtgtccagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2537 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctcaggtgcagctggtgcagtctggccccgaagtgaagaaacccggcgagtccgtgaagatcagctgcaaggccagcggctacaccttccggcactacagcatgaactgggtcaagcaggccccaggccagggcctgaagtggatgggcagaatcaacaccgagagcggcgtgcccatctacgccgacgacttcaagggccggttcagcttcaccgtggacaccagcgccagcaccgcctacctggaaatctccagcctgaccagcgaggataccgccgtgtatttctgctccaacgactacctgtacagcctggatttctggggccagggaaccaccctgacagtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2538 - DNA, 3336 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctcctagtgtgtctggcgctcctggacagagagtgaccatcagctgtacaggcagcagcagcaatatcggagccggctttgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctacgttttcggcaccggcaccaaagtgacagtgcttggtggcggaggcggaagtggaggcggaggatctggcggcggaggctctcaagttcagctggttcagagcggagccgaagtgaagaaacctggggcctctgtgaaggtgtcctgcaaggcttccggctacacctttaccgattactacatgcactgggtccgacaggctcccggccaaagacttgaatggatgggctggatcaaccccaacagcggcggcacaaattacgcccagaagttccaggaccggatcaccgtgaccagagacaccagctccaacaccggctacatggaactgacccggctgagatccgatgacaccgccgtgtactactgcgctagaagcccttactccggcgtgctggataagtggggacagggcacactggtcaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2539 - DNA, 3330 bp, Artificial Sequence
  Synthetic Polynucleotide encoding a CAR with optional accessory module(s)
atggccttaccagtgaccgccttgctcctgccgctggccttgctgctccacgccgccaggccgcaggctgttctgacacagcctccatctgcctctggcacacctggacagagagtgaccatctcctgtagcggcagcagcagcaacatcggcagctacaccgtgtcctggtatcagcagctccctggaacagcccctaagttcctgatctacagcaacaaccagcggcctagcggcgtgcccgatagattttctggcagcaagagcggcacaagcgccagcctggctatttctggactccagtctgaggacgaggccgactactattgtgccgcctgggacgatagcctgaacggctatgtgtttggcaccggcaccaaagtgacagtgcttggtggcggaggcggaagtggaggcggaggatctggcggcggaggctctgaagttcaactggttcagagcggagccgaagtgaagaagcctggcgagagcctgaagattagctgcaaaggcagcggctacgacttcaccacctactggatcggctgggtccgacagatgcctggcaaaggactggaatggatgggcatcatctaccccggcgacagcgacaccagatacagccctagcgttagaggccgcgtgaccatcagcgccgacaagtctatcaacaccgcctacctccagtggtccagcctggaagcctctgacaccgccatgtactactgcgccagaatgtggaccttcagccaggatggatggggccagggaacactggtcacagtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2540 - DNA, 3363 bp, Artificial Sequence
  Synthetic Polynucleotide encoding a CAR with optional accessory module(s)
atggccttaccagtgaccgccttgctcctgccgctggccttgctgctccacgccgccaggccgctgcctgttctgacacagcctccatctgcctctggcacacctggacagagagtgaccatcagctgtagcggcagaagcagcaacatcggcagcaacagcgtgaactggtacagacagcttcctggcgctgcccctaagctgctgatctacagcaacaaccagcggcctcctggcgtgccagtcagattttctggcagcaagagcggcacaagcgccagcctggctatttctggactccagtctgaggacgaggccacctactactgtgccacctgggacgacaacctgaacgtgcactacgtgttcggcaccggcaccaaagtgacagtgcttggaagtagaggcggaggcggaagtggaggcggaggatctggcggcggaggctctcttgaaatggctcaggtgcagctggtgcagagcggagccgaagtgaagaaacctggcagcagcgtgaaggtgtcctgcaaagcttctggcggcaccttcagcagctacgccatctcttgggttcgacaggcccctggacaaggactggaatggatgggcagaatcatccccatcctgggaatcgccaactacgcccagaaattccagggcagagtgacaatcaccgccgacaagagcaccagcaccgcctacatggaactgagcagcctgagaagcgaggacaccgccgtgtactattgtgcaagaggcggctactacagccacgacatgtggagcgaagattggggccagggcacactggtcacagtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2541 - DNA, 3330 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2542 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaggcggaggcggaagtggaggcggaggatctggcggcggaggctctcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2543 - DNA, 3336 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgcaagagcagccagagcatcctgtacagcagcaaccagaagaactacctggcctggtatcagcagaagcccggccagagccctaagctgctgatctactgggccagcaccagagaaagcggcgtgcccgatagattcagcggcagcggctctggcaccgacttcaccctgaccatcagttctcttcaggccgaggacgtggccgtgtactactgccaccagtacatcagctcctacaccttcggccagggcaccaagctggaaatcaagggcggaggcggaagtggaggcggaggatctggcggcggaggctctcaggtgcagctggtgcagtctggcgctgaagtgaagaaacctggggccagcgtgaaggtgtcctgcaaggccagcggctacacctttgccagccagtggatgcactggatgagacaggcccctggacagggcctggaatggatcggctggatcaaccccggcaacgtgaacaccaagtacaacgagaagttcaagggcagagccaccctgacagtggacaccagcaccaacaccgcctacatggaactgagcagcctgcggagcgaggacaccgccgtgtattattgcgccagaagcacctggtacagacccctggattattggggccagggaacccttgtgaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2544 - DNA, 3708 bp, Artificial Sequence
  Synthetic Polynucleotide encoding a CAR with optional accessory module(s)
atggttaggggcgttccattcagacatctgcttctggtcttgcagcttgcactcttgcccgctgccacccagggcaaaaaagtggtgctgggcaagaaaggcgacaccgtggaactgacctgcaccgccagccagaagaagtccatccagttccactggaagaacagcaaccagatcaagatcctgggcaaccagggcagcttcctgaccaagggacccagcaagctgaacgacagagccgacagcagacggtccctgtgggaccagggcaatttcccactgattatcaagaacctgaagatcgaggacagcgacacctacatctgcgaggtggaagatcagaaagaagaggtgcaactgctggtgttcggcctgaccgccaactccgacacccatctgctccagggccagagcctgaccctgacactggaaagccctccaggcagctcccccagcgtgcagtgtagaagcccacgaggcaagaacatccagggaggcaaaacattgtcagtgtcccaactggaactccaggactccggcacctggacctgtaccgtgctccagaaccagaaaaaggtggagttcaagatcgacatcgtggtgctggccttccagaaagcctctggcggaggcggaagtggaggcggaggatctggcggcggaggctctatctaccaggaactgacacaactgaaggccgccgtggaacggctgtgccacccttgtccttgggagtggaccttctttcagggcaactgctacttcatgagcaacagccagcggaactggcacgacagcatcaccgcctgcaaagaagtgggagcccaactggtcgtgattaagagcgccgaggaacagaacttcctccaactccagagcagcagaagcaacagattcacctggatgggcctgagcgacctgaaccaggaaggcacctggcagtgggtggacggatctcctctgctgcccagcttcaagcagtattggaaccggggcgagcccaacaacgtgggcgaagaggattgcgccgagttcagcggcaacggctggaacgacgacaagtgcaacctggctaagttctggatctgcaagaagtccgccgcctcctgtagccgggatgaggaacagttcctgagccctgcccctgccacccctaatcctccaccagctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2545 - DNA, 3336 bp, Artificial Sequence
  Synthetic Polynucleotide encoding a CAR with optional accessory module(s)
atggccttaccagtgaccgccttgctcctgccgctggccttgctgctccacgccgccaggccggaccacatcgtgctgacccagagccctagcagcctgtctgccagcctgggcgacagagtgaccatcagctgtagagccagccaggacatcagcacctacctgaactggtatcagcagaaacccgacggcaccgtgaagctgctgatcttctacaccagcagactgcacgccggggtgcccagcagattttctggcagcggctctggcacccaccacagcctgaccatctccaacctggaacaggaagatattgctacctacttctgtcagcaaggcaacagcctgcccttcaccttcggcagcggcaccaagctggaaatcaagagaggcggaggcggaagtggaggcggaggatctggcggcggaggctctcaggtgcagctgaaagagagcggccctgagctggaaaagcctggggccagcgtgaagattagctgcaaggccagcggctacagcttcaccgcctacagcatgaactgggtcaagcagaacaacggcatgagcctggaatggatcggcagcatcgacccctactacggcgacaccaaatacgcccagaagttcaagggcaaggccaccctgaccgtggataaggccagcagcaccgcctacctccagctgaagtctctgaccagcgaggacagcgccgtgtactactgcgccagacggatgattaccaccggcgactggtacttcgacgtgtggggagccggaaccaccgtgacagtgtctagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2546 - DNA, 3336 bp, Artificial Sequence; identical to SEQ ID NO: 2545
  Synthetic Polynucleotide encoding a CAR with optional accessory module(s)

SEQ ID NO: 2547 - DNA, 3177 bp, Artificial Sequence
  Synthetic Polynucleotide encoding a CAR with optional accessory module(s)
atggcccttccagtcactgccttgctgttgcctctggcgctcctgctccacgccgctagaccgggcatgagaaccgaggacctgcctaaggccgtggtgttcctggaaccccagtggtacagagtgctggaaaaggacagcgtgaccctgaagtgccagggcgcctacagccccgaggacaatagcacccagtggttccacaacgagagcctgatctccagccaggccagcagctacttcatcgacgccgccaccgtggacgacagcggcgagtatagatgccagaccaacctgagcaccctgagcgaccccgtgcagctggaagtgcacatcggatggctgctgctgcaggcccccagatgggtgttcaaagaagaggaccccatccacctgagatgccactcttggaagaacaccgccctgcacaaagtgacctacctgcagaacggcaagggcagaaagtacttccaccacaacagcgacttctacatccccaaggccaccctgaaggactccggctcctacttctgcagaggcctcgtgggcagcaagaacgtgtccagcgagacagtgaacatcaccatcacccagggcctggccgtgtctaccatcagcagctttttcccacccggctaccagacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2548 - DNA, 3177 bp, Artificial Sequence
  Synthetic Polynucleotide encoding a CAR with optional accessory module(s)
atggccttaccagtgaccgccttgctcctgccgctggccttgctgctccacgccgccaggccgggcatgcggactgaagacctcccaaaggctgtggtgttcctggagcctcaatggtacagggtgctggagaaggacagtgtgactctgaagtgccagggagcctactcccctgaggacaattccacacagtggtttcacaatgagagcctcatctcaagccaggcctccagctacttcattgacgctgccacagtggacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggcttgttgggagtaaaaatgtgtcttcagagactgtgaacatcaccatcactcaaggtttggcagtgtcaaccatctcatcattctttccacctggctaccaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2549 - DNA, 3336 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaagtgcagctggtggaatcaggcggcggactggtgcagcctggcagaagcctgagactgagctgtgccgccagcggcttcaccttcaacgactacgccatgcactgggtgcgccaggcccctggaaaaggactggaatgggtgtccacaatcagctggaacagcggcagcatcggctacgccgatagcgtgaagggccggttcaccatcagccgggacaacgccaagaagtccctgtacctccagatgaacagcctgcgggccgaggacacagccctgtactattgcgccaaggacatccagtacggcaactactactacggcatggacgtgtggggccagggaaccaccgtgaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2550 - DNA, 3342 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacccccctgagcctgcctgtgacacctggcgagcctgccagcatctcctgcagaagcagcaagagcctgctgcacagcaacggcatcacctacctgtactggtatctgcagaaacccggccagagcccccaactgctgatctaccagatgagcaacctggtgtccggcgtgcccgacagattttctggcagcggctccggcaccgacttcaccctgaagatcagccgggtggaagccgaggacgtgggcgtgtactactgcgcccagaacctggaactgccctacacctttggcggcggaacaaaggtggaaatcaagcggggcggaggcggaagtggaggcggaggatctggcggcggaggctctcaggtgcaactggtgcagagcggagccgaagtgaaaaagcccggcagcagcgtgaaggtgtcctgcaaggccagcggctacgccttcagctactcctggatcaactgggtgcgccaggcccctggacagggcctggaatggatgggcagaatcttccccggcgacggcgacaccgactacaacggcaagttcaagggcagagtgaccatcaccgccgacaagagcaccagcaccgcctacatggaactgagcagcctgcggagcgaggataccgccgtgtactattgtgccagaaacgtgttcgacggctactggctggtgtactggggccagggaacacttgtgaccgtgtccagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2551 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccatcatcacagcctctccaggcgagaaagtgaccatgacctgtagagccagcagcagcgtgaactacatggactggtatcagaagaagcccggcagcagccccaagccttggatctacgccacaagcaatctggcctctggcgtgcccagcagattttctggctctggcagcggcaccacctacagcatgacaatctctagcctggaagccgaggacgccgccacctactattgtcagcagtggtccttcaatcctcctaccttcggcggaggcaccaagctggaaatcaaaagaggcggaggcggaagtggaggcggaggatctggcggcggaggctctgaagttcagcttcagcagagcggagccgagctgaagaaacctggcgcttctgtgaaggtgtcctgcaaggccagcggctacacctttaccagctacaacatgcactgggtcaagcagaccccaggccagggactcgaatggatcggagccatctatcccggcaacggcgacacctcctacaaccagaagttcaagggcaagaccacactgaccgccgacaagagcagctccaccgcctacatggaactgagcagcctgagatccgaggataccgccgtgtactactgcgccagaagcaactactacggcagctcctactggttcttcgacgtgtggggcaccggcacaaccgtgacagtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2552 - DNA, 3342 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcgactggcccctgacatttggcggcggaacaaaggtggaaatcaaaggcggaggcggaagtggaggcggaggatctggcggcggaggctctgaagtgcaactggttcaatcaggtggcggcctggttcaccctggcggatctctgagactgtcttgtaccggcagcggcttcaccttcagctaccacgccatgcactgggtccgacaggcacctggaaaaggactggaatgggtgtccatcatcggcacaggcggcgtgacctactacgccgattctgtgaagggcagattcaccatcagccgggacaacgtgaagaacagcctgtacctccagatgaactccctgagagccgaggatatggccgtgtattattgcgccagagactactacggcgctggcagcttttacgacggcctgtacggaatggatgtgtggggccagggaaccaccgtgactgtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2553 - DNA, 3336 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacatttggcggaggcaccaaggtggaaatcaaaggcggaggcggaagtggaggcggaggatctggcggcggaggctctgctgtgcagctcgttgagtctggcggaggacttgttcagcctggcagatccctgagactgtcttgtgccgccagcggcttcaccttcggcgattacacaatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactattgcaccaaggacaaccagtacggctccggcagcacatacggacttggagtttggggccagggcaccctggttacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2554 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagcctctgatctacgcccctagcaatctggcctctggcgtgccaagcagattttctggcagcggctctggcaccgacttcaccctgacaatatccagcctccagcctgaggacttcgccacctactactgccagcagtggtccttcaatcctcctaccttcggccagggcaccaaggtggaaatcaaaagaggcggaggcggaagtggaggcggaggatctggcggcggaggctctgaagtgcagcttgttgaatctggcggcggactggttcagcctggcggatctctgagactgtcttgtgccgccagcggctacaccttcaccagctacaatatgcactgggtccgacaggcccctggcaaaggacttgaatgggtcggagccatctatcccggcaacggcgacacctcctacaaccagaagttcaagggcagattcaccatcagcgtggacaagagcaagaacaccctgtacctccagatgaactccctgagagccgaggacaccgccgtgtactattgtgccagagtggtgtactacagcaacagctactggtacttcgacgtgtggggccagggaaccctggtcacagtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2555 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggacatccagctcacacagagcccttctagcctgtctgccagcgtgggcgatagagtgaccatgacctgtagagccagcagcagcgtgtcctacatccactggttccagcagaagcctggcaaggcccctaagccttggatctacgccaccagcaatctggcctctggcgtgccagtcagattttctggcagcggctctggcaccgactacaccttcacaatatccagcctccagcctgaggacattgccacctactactgccagcagtggacctccaatcctcctacctttggcggaggcaccaagctggaaatcaaaggcggaggcggaagtggaggcggaggatctggcggcggaggctctcaggttcagctccagcagtctggggccgaagtgaagaaacctggcagctccgtgaaagtgtcctgcaaggccagcggctacacctttaccagctacaacatgcactgggtcaagcaggcccctggacagggactcgaatggatcggagccatctatcccggcaacggcgacacctcctacaaccagaagttcaagggcaaagccacactgaccgccgacgagagcacaaacaccgcctacatggaactgagcagcctgagaagcgaggacaccgccttctactactgtgcccggtctacctactacggcggcgactggtactttgacgtgtggggccagggaaccaccgtgacagtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2556 - DNA, 3363 bp, Artificial Sequence
  Synthetic Polynucleotide encoding a CAR with optional accessory module(s)
atggccttaccagtgaccgccttgctcctgccgctggccttgctgctccacgccgccaggccgagcaccgtgatgacacagagccctgatagcctggccgtgtctctgggagagagagccaccatcaactgcaagagcagccagagcaacagcaacgacgtggcctggtatcagcagaagccaggacagagccccaaggtgctgatctacttcgccagcaacagatacagcggcgtgcccgatagattttccggcagcggctacggcaccgacttcacccttacaatcagcagcctccaggccgaggatgtggccgtgtacttctgtcagcaagactacagcagccctctgacctttggagccggcaccaagctggaactgaaaagagctgacgctggcggaggcggaagtggaggcggaggatctggcggcggaggctctcagattcagctggtgcagtctggcagcgagctgaagaaacctggggcctctgtgaaggtgtcctgcaaggcttccggctacacctttaccaacttcggcgtgaactgggtccgacaggcccctggaaaaggactggaatggatgggctggatcaacacctacaccggcgagcctagctacgcccagggctttacaggcagattcgtgttcagcctggacgcctctgtgtctaccgcctacctccagatcagctccctgaaagccgaggacaccgccacctatttctgcaccagacggaccaactactacgggacctcctactactacgctatggactactggggccagggcaccaccgtgacagtgtctagcgccaagacaaccacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2557 - DNA, 3339 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctggcggaggcggaagtggaggcggaggatctggcggcggaggctctcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2558 - DNA, 3333 bp, Artificial Sequence; identical to SEQ ID NO: 2554
  Synthetic Polynucleotide encoding a CAR with optional accessory module(s)

SEQ ID NO: 2559 - DNA, 3330 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagcccttctagcctgtctgccagcgtgggcgacagagtgaccatcacatgtagagccagcagcagcctgagcttcatgcactggtatcagcagaagcccggcaaggcccctaagccttggatctacgccaccagcaatctggcctctggcgtgccaagcagattttctggcagcggctctggcaccgactacaccctgacaatatccagcctccagcctgaggacttcgccacctacttttgccaccagtggtccagcaatcctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaggcttccggctacacctttaccagctacaatatgcactgggtccgacaggctcccggccagagacttgaatggatcggagccatctatcccggcaacggcgacacctcctacaaccagaaattcaagggccgcgtgaccgtgaccagagacacatctgccaacaccgcctacatggaactgtctagcctgaagtccgaggacaccgccgtgtactactgtgccagaagccactacggcagcaactacgtggactacttcgactactggggccagggcacactggtcacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2560 - DNA, 3336 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaggtgcagcttgttgagtctggcggaggactggtgcagcccgatagaagcctgagactgtcttgtgccgccagcggcttcaccttccacgattatgccatgcactgggtccgacaggcccctggcaaaggacttgaatgggtgtccaccatctcttggaacagcggcacaatcggctacgccgactctgtgaagggcagattcaccatcagccgggacaacgccaagaacagcctgtacctccagatgaactccctgagagccgaggacacagccctgtactactgcgccaaggacatccagtacggcaactactactacggcatggacgtgtggggccagggcacaacagtgacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2561 - DNA, 3330 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagccagcagcagcgtgccctacatccactggtatcagcagaagcctggacaggcccctcggctgctgatctatgccacatctgctctggcctctggcatccccgatagattttctggcagcggctccggcaccgacttcaccctgacaatcagcagactggaacccgaggacttcgccgtgtactactgtcagcagtggctgagcaaccctcctacattcggccagggcaccaagctggaactgaaaagaggcggaggcggaagtggaggcggaggatctggcggcggaggctctgaagttcagctggttcagagcggagccgaagtgaagaagccaggcgagagcctgaagctgagctgcaaaggcagcggcagaaccttcaccagctacaacatgcactgggtccgacagatgcccggcaaaggactggaatggatgggcgctatctaccctctgaccggcgacacctcctacaaccagaaaagcaagctgcaagtgaccatcagcgccgacaagagcatcagcacagcctacctccagtggtcctctctgaaggccagcgacaccgccatgtactattgtgccagaagcacctacgtcggcggcgactggcagtttgatgtgtggggcaagggcaccaccgtgaccgtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2562 - DNA, 3345 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtcggagcagccagagcatcgtgcactccgtgggcaacaccttcctggaatggtatcagcagaagcccggcaaggcccccaagctgctgatctacaaggtgtccaacagattcagcggcgtgcccagcaggtttagcggctctggcagcggcaccgacttcaccctgaccatctctagcctccagcccgaggacttcgccacctactactgttttcaaggcagccagttcccctacaccttcggccagggaacaaaggtggaaatcaagcggggcggaggcggaagtggaggcggaggatctggcggcggaggctctgaagtgcaactggtggaaagcggaggcggcctggtgcagcctggcggatctctgagactgagctgtgccgccagcggctacgagttcagccggtcctggatgaactgggtgcgccaggcccctggcaagggactggaatgggtgggaagaatctaccccggcgacggcgacaccaactacagcggcaagttcaagggccggttcaccatcagcgccgacaccagcaagaacaccgcctacctccagatgaacagcctgcgggccgaggataccgccgtgtactactgtgccagagatggcagctcctgggactggtacttcgacgtgtggggacagggaacccttgtgaccgtgtccagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2563 - DNA, 3321 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccagcagcctgtctgccagcgtgggcgacagagtgaccatcacatgcaaggccagccagagcgtgaccaacgacgtggcctggtatcagcagaagcccggcaaggcccccaagctgctgatctactacgccagcaacagatacaccggcgtgcccagcagattcagcggctctggcagcggcaccgacttcaccctgaccatctctagcctccagcccgaggacttcgccacctactactgtcagcaggactacagaagcccctggaccttcggcggaggcaccaaggtggaaatcaagcggggcggaggcggaagtggaggcggaggatctggcggcggaggctctcaggtgcaactggaagaaagcgggggaggcgtcgtgcggcctggaagaagtctgagactgagctgtgccgccagcggcttcaccttcagcgactacggcgtgaactggatcagacaggcccctggcaagggcctggaatgggtcacaatcatctggggcgacggcagaaccgactacaacagcgccctgaagtcccggttcaccgtgtcccggaacaacagcaacaacaccctgagcctccagatgaacagcctgaccaccgaggacaccgccgtgtactactgtgtgcgggctcccggcaaccgggctatggaatattggggacagggcgtactcgtgaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2564 - DNA, 3339 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagggcggaggcggaagtggaggcggaggatctggcggcggaggctctcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2565 - DNA, 3339 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcggcggaggcggaagtggaggcggaggatctggcggcggaggctctgacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2566 - DNA, 3318 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccgccaccatcgagaacacaagcctgtctgccagcgtgggcgacagagtgaccatcacctgtagagccagccagggcatcagctcttggctgacctggtatcagcagaagcccgagaaggcccccaagagcctgatctacgccgccagctctctgcagtctggcgtgcccagcagattttccggcagcggctctggcaccgacttcaccctgacaatcagcagcctgcagcccgaggacttcgccacctactactgccagcagtacgacagctaccccatcaccttcggccagggcacccggctggaaatcaagggcggaggcggaagtggaggcggaggatctggcggcggaggctctcaggtgcaactgcagcagtggggagccggactgctgaagcctagcgagacactgagcctgacctgcgccgtgtacggcggcagcttcagcgcctactattggagctggatcagacagccccctggcaagggcctggaatggatcggcgacatcaatcacggcggaggcaccaactacaaccccagcctgaagtcccgcgtgaccatctccgtggacaccagcaagaaccagttctccctgaagctgaacagcgtgacagccgccgacacagccgtgtactactgtgccagcctgaccgcctattggggccagggatctcttgtgaccgtgtccagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2567 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacccagagccctgatagcctggccgtgtctctgggcgagagagccaccatcaactgcaaggccagccagagcgtggacttcgacggcgacagctacctgaactggtatcagcagaagcccggccagccccccaaggtgctgatctatgccgccagcacactgcagagcggcgtgcccagcagattttctggcagcggctccggcaccgacttcaccctgaccatcaacagcctggaagccgaggacgccgccacctactactgccagcagagcaacgaggacccctggacctttggcggcggaacaaaggtggaaatcaagggcggaggcggaagtggaggcggaggatctggcggcggaggctctcaggtgcaactggtgcagtccggcgctgaagtgaagaaacctggggccagcgtgaaggtgtcctgcaaggtgtccggctacacctttaccgactactacattacctgggtgcgccaggcccctggacaggccctggaatggatgggctggatctaccccggcagcggcaacaccaagtacagccagaagttccagggcagattcgtgttcagcgtggacaccagcgccagcaccgcctacctgcaactgtctagcctgaaggccgaagataccgccgtgtactactgcgccaactacggcaactattggttcgcctattggggccagggaacccttgtgaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2568 - DNA, 3324 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtgcagtctggcggagggctggtgcatcctgggggaagcctgagactgagctgtgccggctctggcttcgccttcagcagcagcaccatgcactggatcagacaggcccctggcaagggcctggaatggatcagcctgatcggaagcggagggggcatctactacggcgacagcgtgaagggccggttcaccatcagccgggacaacgccaagaacagcctgtacctccagatgaactccctgcgggccgaggacatggccgtgtactattgtgtgcggggctacttcgactgggtggactacttcgattactggggccagggcaccctcgtgaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2569 - DNA, 3354 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgatgacacagtcaccagatagcctcaccgtctccctgggggagcggaccaccattaattgtaaatccagccaaagcgtgctggactcaagcaagaacaagaatagcctcgcctggtatcagcagaagcccggtcagcctccaaagctgctgctttcttgggcctccaccagagagtccgggattcctgataggtttagtggttcaggctccggcacagattttactctgaccattgattctctccagccagaggattctgcaacttattactgccagcaaagcgcccactttcctataacttttggccagggaacccgacttgaaatcaagggcggaggcggaagtggaggcggaggatctggcggcggaggctctcaggtgcagctggtgcagagcggtgccgaagtgaagaaaccaggtgcatccgttaaagtttcatgtaaggctagtggatataccttcaccaattacggaatgaactgggtgaaacaggcccctggccagggactgaagtggatggggtggattaacacctacaccggggagccgacttatgcagacgactttaaggggcgggtcacgatgacctccgacacctccaccagtaccgcctacctggagctgcacaaccttaggtcagacgataccgccgtgtattactgtgcccgatggtcttggtccgacggatactatgtctacttcgactattggggccaggggaccacagttaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2570 - DNA, 3342 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctggaagcctggccgtgtctcctggcgagcgcgtgacaatgagctgcaagagcagccagagcgtgttcttcagcagctcccagaagaactacctggcctggtatcagcagatccccggccagagccccagactgctgatctactgggccagcaccagagaaagcggcgtgcccgatagattcaccggcagcggctctggcaccgacttcaccctgacaatcagcagcgtgcagcccgaggacctggctatctactactgccaccagtacctgagcagccggaccttcggccagggcaccaagctggaaatcaagagaggcggaggcggaagtggaggcggaggatctggcggcggaggctctcaggtgcaactgcagcagcctggcgctgaggtcgtgaagccaggcgcttccgtgaagatgtcctgcaaggccagcggctacaccttcaccagctactacatccactggatcaagcagacccctggacagggcctggaatgggtgggagtgatctaccccggcaacgacgacatcagctacaaccagaagttccagggcaaggccaccctgaccgccgacaagtctagcaccaccgcctacatgcaactgtccagcctgaccagcgaggacagcgccgtgtactactgcgccagagaagtgcggctgcggtacttcgatgtgtggggccagggaaccaccgtgaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2571 - DNA, 3420 bp, Artificial Sequence
  Synthetic Polynucleotide encoding a CAR with optional accessory module(s)
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatccagctgacacagagcccttctagcctgtctgccagcgtgggcgacagagtgaccatcacatgtagagccagccagggcatcagctctgtgctggcttggtatcagcagaagcctggcaaggcccctaagctgctgatctacgatgccagcagcctggaaagcggcgtgccaagcagattttctggcagcggctctggcaccgacttcaccctgacaatatccagcctccagcctgaggacttcgccacctactactgccagcagttcaacagcagcatcaccttcggccagggcaccaagctggaaatcaagagaacagtggcagccggcggaggcggaagtggaggcggaggatctggcggcggaggctctcaagttcagctggttcagtctggggccgaagtgaagaaacctggcagcagcgtgaaggtgtcctgcaaagcaagcggcggcaccttcagcgattacgccatctcttgggtccgacaggcccctggacaaggactggaatggatgggcagaatcatccccatcctgggcgtcgccaattacgcccagaaattccagggccgcgtgacaatcaccgccgacaagtctaccagaaccgcctacatggaactgagcagcctgagaagcgaggacaccgccgtgtactactgcgccagaaattgggccgacgccttcgacatttggggccagggaacaatggtcaccgtgtctagcgcctccacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2572 - DNA, 3417 bp, Artificial Sequence
  Synthetic Polynucleotide encoding a CAR with optional accessory module(s)
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatcgtgatgacacagagccctagcagcctgtctgcctctctcggcggcaaagtgaccatcacatgcaaggccagccaggacatcaacaagtatatcgcctggtatcagcacaagcccggcaagggacctagactgctgatccactacaccagcacactccagcctggcatccccagcagattttctggcagcggctccggcagagactacagcttcagcatcagcaacctggaacctgaggacattgccacctactactgcctccagtacgacaacctgctgacctttggagccggcaccaagctggaactgaaaagaggcggaggcggaagtggaggcggaggatctggcggcggaggctctgaagtgaaactccagcagagcggccctgagctggttaagcctggcaccagcgtgaaggtgtcctgtaaagccagcggctactccttcaccgactacaacatgtactgggtcaagcagagccacggcaagagcctggaatggatcggctacatcgacccctacaaaggcggcaccatctacaaccagaagttcaagggcaaagccacactgaccgtggacaagagcagcagcaccgccttcatgcacctgaacagcctgaccagcgaggacagcgccgtgtactattgcgccagagagatgattaccgcctactacttcgactactggggccagggaagcagcgtgaccgttagctctctggaaagaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2573 - DNA, 3465 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagatagagtgaccatcaactgcaaggccagccaggacatcaacagctacctgagctggttccagcagaagcctggcaaggcccctaagacactgatctaccgggccaacagactggtggatggcgtgccaagcagattttctggcagcggcagcggccaggattacaccctgacaatatccagcctccagcctgaggacttcgccacctactactgcctccagtacgacgagttccctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaagccagcggctacacctttaccaactacgacatcaactgggtccgacaggctccaggccaaggactggaatggatcggctggatctatcctggcgacggcagcaccaagtacaacgagaagttcaaggccaaggccacactgaccgccgataccagcacaagcaccgcctacatggaactgcggagcctgagaagcgacgacaccgccgtgtactattgtgcctccggctacgaggacgctatggactattggggccagggcaccaccgtgacagtgtctagtgccaagcctaccaccacaccagctccaagacctccaactcctgctcctacaatcgccagccagcctctgtctctcagacccgaagcctgtagacctgctgctggcggagctgtgcataccagaggactggatttcgcctgcgacatcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2574 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctctgagcctgcctgttacacctggcgagcctgccagcatctcctgtagaagctctcagagcctgctgcacagcaacggctacaactacctggactggtatctccagaagcctggacagagcccacagctcctgatctacctgggcgtgaactctgtgtccggcgtgcccgatagattttctggcagcggctctggcaccgacttcaccctgaagatcagcagagtggaagccgaggacgtgggcgtgtactactgtatgcaggccctccagacaccttggacattcggccagggcaccaaggtggaaatcaaaggcggcggaggatctggcggaggtggaagtggcggaggcggatctcaagtgcaactggttcagagcggagccgaagtgaagaaacctggcagcagcgtgaaggtgtcctgcaaagcctctggcggcatcttcagcaaccacgccatctcttgggtccgacaggctcctggacaaggactggaatggatgggcggcatcatccccatcttcggcacagccaattacgcccagaaattccagggcagagtgaccatcaccgccgacgagtctaccagcaccgccttcatggaactgagcagcctgagaagcgaggacaccgccgtgtactattgcgccagagaatgggccgacgtgttcgacatttggggccagggaacaatggtcaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2575 - DNA, 3330 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagtctccagccagcctgaccgtgtcactgggacagagagccaccatctcttgcagagccagcgagagcgtggacagctacggcaatagctacctgcactggtatcagcagaagcccggccagcctcctcagctcctgatctacctggcctccaatctggaaagcggcgtgccagccagattttctggcagcggcagcagaaccgacttcaccctgaccattgatcccgtggaagccgatgatgccgccacctactactgccagcagaacaacgaggacccctggacatttggcggaggcaccaaggtggaaatcaaaggcggcggaggatctggcggaggtggaagtggcggaggcggatctgaagttcagctccagcagagcggagccgagcttgtgaaacctggcgcttccgtgaagatgagctgcaaagccttcggctacaccttcaccacctttccaatcgagtggatgaagcagagccacggcaagagcctggaatggatcggcaactttcacccctacaacgaccagaccaagtacaacgaagagttcaagggcagagccaagctgaccatcgacagatccagcagcaccgtgtacctggaactgggcagactgacctccgatgacagcgccgtgtactactgtgccagaggctactactacgccttcgacttttggggccagggcaccacactgacagtgtctagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2576 - DNA, 3321 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatcagaaacgacctcggctggtatcagcagaagcctggcaaggcccctaagcggctgatctatgccgcttcctctctgcaatctggcgtgcccagcagattttctggcagcggctctggcaccgagttcaccctgacaatatccagcctccagcctgaggacttcgccacctactactgcctccagcacaacagctacccctggacctttggacagggcaccaagctggaaatcaaaggcggaggcggaagtggaggcggaggatctggcggcggaggctctgaagtgcaactggttgaatctggcggcgctctgattcagcctggcggatctctgagactgagctgtgtggcctccggctttaccatcagcggcaactacatgagctgggtccgacaggcccctggcaaaggacttgaatgggtgtccctgatctacagcggcgacagcacctattacgccgacagcgtgaagggcagattcaccatcagccgggacatcagcaagaacaccgtgtacctccagatgaactccctgagagtggaagataccgccgtgtactactgcgtccgcgacggctactacgtgtccgatatggttgtgtggggcaagggcaccaccgtgacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2577 - DNA, 3351 bp, Artificial Sequence
  Synthetic Polynucleotide encoding a CAR with optional accessory module(s)
atggccttaccagtgaccgccttgctcctgccgctggccttgctgctccacgccgccaggccggatgtgctgctgacccagagccctctgagcctgcctgtgacactgggacagcctgccagcatctcctgtcggagcagccagaccatcgtgcacagcaacggcaacacctacctggaatggttccagcagcggccaggccagagccccagactgctgatctaccaggtgtccaacagattcagcggcgtgcccgacagattctccggcagcggctctggcaccgacttcaccctgaagatcagccgggtggaagccgaggacgtgggcgtgtactactgttttcaaggcagccacgtgccccggacctttggcggaggaacaaaggtggaaatcaagagaggcggaggcggaagtggaggcggaggatctggcggcggaggctctcagatccaactggtgcagagcggcagcgagctgaagaaacctggggccagcgtgaaggtgtcctgcaaggccagcggctacacctttaccaactacggcatgaactgggtgcgccaggcccctggacagggcctgaaatggatgggctggatcaacaccaacaccggcgagcctaagtacgccgaagagttcaagggcagattcgccctgagcctggacaccagcgtgtccacagcctacctccagatcaacagcctgaaggccgaggataccgccgtgtacttctgcgccagaggctacggcaactacgccagaggggcttggctggcctattggggccagggaacactcgtgaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2578 - DNA, 3312 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccacactctctctgagccctggcgaaagagccaccctgagctgtagcgccagcagcagcatcaactacatctactggctccagcagaagcccggccaggcccccagaatcctgatctacctgaccagcaacctggcctccggcgtgccagccagattttctggcagcggctccggcaccgacttcaccctgacaatcagcagcctggaacccgaggacttcgccgtgtactactgcctccagtggtccagcaaccccctgacctttggcggaggcaccaaggtggaaatcaagggcggaggcggaagtggaggcggaggatctggcggcggaggctctttcgaagtgcaactggtggaaagcgggggaggacttgtgaagcctggcggctctctgagactgagctgtgccgcctctggcttcaccttcagcagctacgacatgagctgggtgcgccaggctcctggcaagggactggaatgggtgtccaccatcagcagcggcggcagctacacctactacctggacagcatcaagggccggttcaccatctccagagacaacgccaagaacagcctgtacctccagatgaactccctgcgggccgaggacacagccgtgtattattgcgccagacagggcctggattactggggcagaggcacccttgtgaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2579 - DNA, 3336 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgccgggccagcaagagcgtgtccaccagcggctacagcttcatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagaggtgccctggacattcggccagggcacaaaggtggaaatcaagcggggcggaggcggaagtggaggcggaggatctggcggcggaggctctcaggtgcagctggtgcagtctggggccgaagtgaagaaacctggggccagcgtgaaggtgtcctgcaaggccagcggatacacctttaccaactacggcatgaactgggtgcgccaggcccctggacagggcctggaatggatgggctggatcaacacctacaccggcgagcccacatacgccgacgccttcaagggcagattcgccttcagcctggacaccagcacctccaccgcctacctccagatcaacagcctgcggagcgacgacaccgccgtgtattattgcgccagagattacggcgactacgggatggactattggggccagggaaccaccgtgaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2580 - DNA, 3324 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacccccctgaccctgagcgtgacaatcggacagcctgccagcatctcctgcaagagcagccagagcctgctggacagcgacggcaagacctacctgaactggctgctgcagaggccaggccagagccccgagagactgatctacctggtgtccaagctggactccggcgtgcccgatagattcacaggcagcggctccggcaccgacttcaccctgaagatcagccgggtggaagccgaggacctgggcgtgtactgttgttggcagggcacccacttcccttacaccttcggcggagggaccaaggtggaaatcaagggcggcggaggcggaagtggaggcggaggatctggcggcggaggctctcaggtgcaactgcagcagcctggcgctgaacttgtgcggccaggcgcctctgtgaagctgagctgtaaagccagcggctacaccttcaccagctactggatgaactgggtcaagcagcgcccaggccagggcctggaatggatcggaatgatcgaccccagcgacagcgagacacactacaaccacatcttcaaggacaaggccaccctgaccgtggacaagtccagcagcacagcctacctgcaactgtccagcctgaccagcgaggacagcgccgtgtactactgcgcccggaacctgtatctgtggggccagggaacaagcgtgaccgtgtctagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2581 - DNA, 3336 bp, Artificial Sequence
  Synthetic Polynucleotide encoding a CAR with optional accessory module(s)
atggccttaccagtgaccgccttgctcctgccgctggccttgctgctccacgccgccaggccggacgacatccagttgacccagtcccccagctcactcagcgccagtgtgggggaccgggtgaccattacctgtaaagccagtcagagtgtggactatgagggggatagcttcctgaattggtatcagcagaagcctggcaaagccccaaagctgctgatctacgctgcatctaatctggagtcaggcgtgccttctaggttctccggtagtgggtctgggaccgatttcacattgaccatttcatccctccaacccgaggatttcgctacatattactgtcagcagtccaatgaggaccctctcacctttggccagggcaccaaagttgaaattaagagaggcggaggcggaagtggaggcggaggatctggcggcggaggctctgaagtccaacttgtggagtctggagggggcctggtgcagcccggcggctctctcagactgtcttgtgcggcaagcggctacaccttcagctcttactggatagaatgggtgaggcaggcacctggaaagggactggagtggattggagagattctgccaggagggggagatacaaattacaatgaaatcttcaaggggcgggccaccttttcagcggataccagcaagaatacagcttacctgcagatgaatagcctccgggcagaagataccgctgtttattattgcacgagacgggtgccaataagactggactattgggggcaagggactcttgtcaccgtcagttcaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2582 - DNA, 3324 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacacctctgagcctgagcgtgacacctggacagcctgccagcattagctgcaagagcagccagtctctgctggacggcgacggcaagacctacctgaattggctgctccagaagcctggacagagccctcagcggctgatctacctggtgtccaagctggatagcggcgtgcccgatagattttctggcagcggctctggcaccgacttcaccctgaagatcagcagagtggaagccgaggacgtgggcgtgtactactgttggcagggcacacacttccccagaacattcggccagggcacaaagctggaaatcaaaggcggaggcggaagtggaggcggaggatctggcggcggaggctctcaagtgcaactggttcagagcggagccgaagtgaagaaacctggggcctctgtgaaggtgtcctgcaaggccagcggctacaccttcaaggacacctacatccactgggtccgacaggcccctggacaaggacttgagtggatgggcagaatcgaccccgccaacggcaacaccaaatacgaccccaagttccagggcagagtgaccatgaccagagacaccagcatcagcaccgcctacatggaactgagccggctgagatccgatgacaccgccgtgtactattgcgctagaagaggcggagtggattggggccagggaacactggttaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2583 - DNA, 3348 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgcgagagcagccagagcctgctgaacagcggcaaccagaagaactacctgacctggtatcagcagaagcccggccagccccccaagcccctgatctattgggccagcaccagagaaagcggcgtgcccgatagattcagcggcagcggaagcggcaccgacttcaccctgaccatcagttctcttcaggccgaggacgtggccgtgtactactgccagaacgactacagctacccctacaccttcggccagggcaccaagctggaaatcaagagaggcggaggcggaagtggaggcggaggatctggcggcggaggctctgaagtgcagctggtgcagtctggggccgaagtgaagaagcctggcgagagcctgaagatcagctgcaagggcagcggctacagcttcaccgactactacatgaagtgggccagacagatgcccggcaagggcctggaatggatgggcgacatcatccccagcaacggggccaccttctacaaccagaaattcaagggccaagtgaccatctccgccgacaagagcatcagcaccacctacctccagtggtccagcctgaaggccagcgacaccgccatgtactattgcgccagaagccatctgctgcgggccagttggttcgcctattggggccagggaacaatggtcacagtgtccagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2584 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaaggcggaggcggaagtggaggcggaggatctggcggcggaggctctcagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2585 - DNA, 3345 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctgaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2586 - DNA, 3345 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2587 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcaggactacggcttcccttggacctttggacagggcaccaaggtggaaatcaagagaggcggaggcggaagtggaggcggaggatctggcggcggaggctctgaagttcaactggttcagagcggagccgaagtgaagaagcctggcgagagcctgaagattagctgcaaaggctccggctactccttcaccagctactggatctcttgggtccgacagatgcccggcaaaggactggaatggatgggcatcatcgaccccagcgacagcgacaccagatacagccctagcttccagggccaagtgaccatcagcgccgacaagagcatcagcacagcctacctccagtggtcctctctgaaggccagcgataccgccatgtactattgcgccagaggcgacggcagcaccgacctggattattggggacagggaaccctggtcaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2588 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccgcagttcgtgctgacacagcctccaagcgtgtccaccaatcctggcagcacagtgaagctgagctgcaagagaaacaccggcaacatcggcagcaactacgtgaactggtatcagcagaagcccggacagagccccaccaccatgatctacagagatgacaagaggcccgacggcgtgcccgatagattttccggctctatcgacagaagcagcaacagcgccctgctgaccatcaacaacgtgcagacagaggacgaggccgactacttctgccagagctacagcagcggcatcaacatcatcttcggcggaggcaccaagctgacagttcttggcggaggcggaagtggaggcggaggatctggcggcggaggctctcaagtgcagctccaagaatctggccctggcctggtcaagcctagcgagacactgagcctgacctgtaccgtgtccggctttagcctgaccacctacgacgtgcactgggtccgacaacctccaggcaaaggactggaatggatgggcagaatccagaacgccggcatcaccgactacaatagcgccctgaagtcccggctgattatctccagagacaccagcaagagccaggtgttcctgaagatgaacagcgtgaccaccgccgacaccgccatgtacttttgtgccaagaccggcagctacttctacgccttcgatcactggggccagggcacactggttaccgtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2589 - DNA, 3324 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagtctccagccagcctgtctgcctctctgggagagacagtgaccatcgagtgcagacccagcgaggacatccacagcaacgtggcctggtatcagcagaagcccggcaattctccccagctgctgatctacgacgccagcaatctggctgatggcgtgcccagcagattttctggcagcggctctggcacacagtacagcctgaagatcaacagcctccagagcgaggacgtggcctcctacttctgccaccagtacaacatctacccctacaccttcggcagcggcaccaagctggaacttaaaggcggaggcggaagtggaggcggaggatctggcggcggaggctctcaagttcagctgcaagagtctggccccacactggtcaagcctggcgatagcgtgaagatgagctgcaaggccagcggctacacctttaccgactacatcatccactgggtcaagcagagccacggcaagagcctggaatggatcggctacatcaacccttacagcgacggcaccaactacaacgagaagttcaagagcaaggccacactgaccgtggacaagagcaccagcacagcctacatggaattttcccggctgacctccgaggacagcgccatctatttctgcgccctgaactacggcagctactacgctatggatgcctggggccagggcacaagcgtgacagtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2590 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacctttggacagggcaccaaggtggaaatcaagagaggcggaggcggaagtggaggcggaggatctggcggcggaggctctgaagttcagctccttgagagtggtggcggcctggttcaacctggcggatctctgagactgtcttgtgccgccagcggcttcacctttagcggctattggatgcactgggtccgacaggcccctggcaaaggacttgaatgggtgtccgccatcagaagcgacggcagcagcaagtactacgccgactctgtgaagggcagattcaccatcagccgggacaacagcaagaacaccctgtacctccagatgaacagcctgagagccgaggacacagccgtgtattattgcgccaaggacggcgtgatcgaggacacctttgattactggggccagggcaccctggtcaccgtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2591 - DNA, 3315 bp, Artificial Sequence
  Synthetic Polynucleotide encoding a CAR with optional accessory module(s)
atggccttaccagtgaccgccttgctcctgccgctggccttgctgctccacgccgccaggccggacgtgcagatcacacagagccctagctacctggctgcctctcctggcgagacaatcaccatcaactgtcgggccagcaagagcatcagcaaggacctggcctggtatcaagagaagcccggcaagaccaacaagctgctgatctacagcggcagcacactccagtctggcatccccagcagattttccggctctggcagcggcaccgatttcaccctgaccataagcagcctggaacctgaggacttcgccatgtactactgccagcagcacaacaagtacccctacacctttggcggaggcaccaagctggaaatcaagagaggcggaggcggaagtggaggcggaggatctggcggcggaggctctcaagttcaactgcaacagcctggggccgagcttgttagacctggcgcttctgtgaagctgagctgcaaggccagcggctacaccttcaccagctactggatgaactgggtcaagcagcggcctgaccagggcctcgaatggatcggcagaatcgacccctacgacagcgagacacactacaaccagaagttcaaggacaaggccatcctgaccgtggacaagagcagctccaccgcctacatgcaactgagcagcctgacctctgaggatagcgccgtgtactattgcgccagaggcaactgggacgactattggggccagggcacaaccctgacagtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2592 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatccagatgacacagtctccagccagcctgtctgcctctctgggagagacagtgaccatcgagtgccggaccagcaaggacatctacagcaacctggcctggttccagcaagagcccggcaattctcctcagctcctgatctacgacgccagcaatctggctgatggcgtgcccagcagattttctggcagcggctctggcacacagtacagcctccagatcaacaacctccagagcgaggacgtggcctcctacttctgccaccagtacaacaactacccctacaccttcggcaccggcaccaagctggaacttaaaggcggaggcggaagtggaggcggaggatctggcggcggaggctctcaagtgcagctccaagagtctggccccacactggtcaatcctggcgacagcgtgaagatgagctgcaaggccagcggctacacctttaccgaccacatcatccactgggtcaagcagagccacggcaagagcctggaatggatcggctacatcaacccctatagcggcggagccaactacaacggcaagttcaagagcaaggccacactgacaatcgacaagagcagcagcaccgcctacatggaattttccagactgaccagcggcgactccgccatctactactgcgccctgaattacggcagctactacgctatggatgcctggggccagggcacaagcgtgacagtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2593 - DNA, 3321 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctaccagcatgacagcctctccaggcgagcaagtgaccatcacctgtagagccagcagcagcatcaactacatgcactggtatcagcagaagcctggcgcaagccccagaccttggatctacgagacaagcaagctggcctccggcgtgcccgatagattttctggatctgccagcggcaccagctacagcctgaccatcaacaacatggaagccgaggacgccgccacctactactgccagcagtggaattacccctcctggacctttggcggaggcaccaagctggaacttaaaggcggaggcggaagtggaggcggaggatctggcggcggaggctctgaagtgcagctcgttgagtctggtggcggactggttcagcctggaagaagcctgaagctgagctgtgccgccagcggcttcaccttcagcgactacaatatggcctgggtccgacaggcccctaagaaaggactggaatgggtcgccaccatcctgtacgatggcggcagaacctactaccggggcagcgtgaagggcagattcaccatcagcagagacaacgccaagagcaccctgtacctgcggatggactctctgagaagcgaggataccgccacatattactgtgccacacacagccggggcaccgactactttgattattggggccagggcgtgatggttaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2594 - DNA, 3348 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacacagagcccttctagcctggccgtgtctgagggcgagacagtgaccatcaactgcaagagcagccagagcttcctgtctagcggcgacggcaagaattacgtggcctggtatcagtacaagcccggacagagccccaagctgctgatctactgggccagcacaagacagagcggcgtgcccgatagattcatcggctctggcagcggcaccgacttcaccctgacaatctctacagtgcaggccgaggacctggctatctactactgccagcagtattacgacacccctctgacctttggctccggcaccaagctggaaatcaaaggcggaggcggaagtggaggcggaggatctggcggcggaggctctgaagtgaagctgcaagagtctggccccagcctggtgcagagtagccaaacactgagcctgacctgtaccgtgtccggctttagcctgaccagctaccacatccactgggtccgacagacccctggcaaaggactggaatggatgggcgtgatgtggagcgacggcgacaccagctataacagcgccctgaagtcccggctgagcatcagcagagatacaagccagagccaggtgttcctgaagatgaacagcctccagaccgaggacaccgccacctactattgtgccagaggctactacagcagctacctgtacctttggttcgcctattggggccagggcaccctggttacagtcagctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2595 - DNA, 3360 bp, Artificial Sequence
  Synthetic Polynucleotide encoding a CAR with optional accessory module(s)
atggccttaccagtgaccgccttgctcctgccgctggccttgctgctccacgccgccaggccggacgtgctgatgacccagacacctgtgtctctgccagtgtctctcggaggccaggtgtccatctcctgtagaagcagccagagcctggtgcactccgacggcgatacctacctgcactggtatctccagaagcctggacagagccctcagctcctgatctaccgggtgtccaacagattcagcggcgtgcccgatagattttccggcagcggctctggcaccgacttcaccctgaagatcagcagagtggaacccgaggacctgggcctgtactactgtctccagaccacacacttcccaccttggacctttggcggaggcaccaagctggaaatgaaaggcggaggcggaagtggaggcggaggatctggcggcggaggctctcaggttcagctccagcagtctggacccgagcttagaaggccaggatctagcgtcagactgagctgcaaggccagcggctaccggatcaaggacttcctgatccactggattaagaacagacccgagcacggcctggaatggatcggatggattgaccctgaggacggcgagactaagtacgcccagaagttccagaccaaggccacactgaccgccgacacctctagcaacaccgcctacatgcaactgagcagcctgaccagcgaggacaccgccacctacttttgtgctagatggggcgacgtgtactacggcctgatgagaggccatgtgatggatgcctggggccagggaacaagcgtgacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2596 - DNA, 3333 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagtctaccagttccctgagtgcatccctcggagacagggtgacgatcagttgcagcgcaagccaagggatcaataactatctgaactggtatcagcagaaaccggacggaacagtcgaactcctgatttattacaccagcacccttcagagtggcgtcccttcccggttcagtggctccggaagcgggaccgattactccctgaccatttctaatctggagccagaggacataggaacgtattattgccagcagtatagtaaactgccacgaacttttggaggggggacgaaactggagatcaaaggcggaggcggaagtggaggcggaggatctggcggcggaggctctcaggtgcaactccagcagtccggaagcgagcttatgatgccaggggcatcagtgaagatcagctgcaaggctactggctacaccttctctaattactggatagagtgggttaaacaaaggccagggcacggcctggaatggatcggcgagatcctgcctgggacaggccgaaccatttataacgagaagttcaaaggcaaggctactttcaccgcagatataagctctaatacagtgcaaatgcagctctcttccctgacaagtgaggatagtgccgtgtattattgcgcacgaagagattactatggaaatttttattacgctatggattattggggtcaaggaacaagtgtgaccgttagcagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2597 - DNA, 3318 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccctgccagcctgtccgtgtctgtgggcgagacagtgaccatcacctgtcgggccagcgagaacatctacagcaacctggcctggtatcagcagaagcagggcaagagcccccaactgctggtgtacgccgccaccaatctggccgatggcgtgcccagcagattttccggctctggcagcggcacccagtacagcctgaagatcaacagcctccagagcgaggacttcggcagctactactgccagcacttctggggcacctggacctttggaggaggcaccaccctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccgactactacatgaagtggatgaagcagagccacggcaagtccctggaatggatcggcgacatcaaccccaacaacggcggcaccacctacaaccagaagttcaagggcaaggccaccctgaccgtggacaagagcagcagcaccgcctacatgcaactgaacagcctgaccagcgaggacagcgccgtgtactactgcgccagagactacggctacggctatttcgactactggggccagggcacaaccctgacagtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2598 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggcctctcagagcgtgggaggctacctggcttggtatcagcagaagccaggccaggcccccagactgctgatctacgacgccagcaatcgggccacaggcatccccgccagattttctggcagcggctccggcaccgacttcaccctgacaatcagcagcctggaacccgaggacttcgccgtgtactactgccagcagcggaacaactggccccccatgtacacattcggccagggcaccaagctggaaatcaagagaggcggaggcggaagtggaggcggaggatctggcggcggaggctctcaggtgcaactggtgcagagcggagccgaagtgaagaaacccggcagcagcgtgaaggtgtcctgcaaggcttccggcggcaccttcagcagctacgccatttcttgggtgcgccaggctcctggacagggcctggaatggatgggcggcatcatccctatcctgggcaccgccaactacgcccagaaattccagggcagagtgaccatcaccgccgacgagagcaccagcaccgcctacatggaactgagcagcctgcggagcgaggacacagccgtgtattattgcgccagatggggcggaggggccttcgacatttggggccagggaacaatggtcaccgtgtccagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2599 - DNA, 3312 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgacacagagccctgccctgatgagcgccagccctggcgagaaagtgaccatgacctgtagcgccagcagcagcgtgcgctacatgtactggtatcagcagaagcccagaagcagccccaagccctggattcacctgaccagcaatctggcctctggcgtgcccgctagattttccggctctggcagcggcaccagctacagcctgaccatcagcagcatggaagccgaggacgccgccacctactactgccagcagtggtccagccaccccttcacatttggctccggcaccaagctggaaatcaagggcggaggcggaagtggaggcggaggatctggcggcggaggctctgatgtgcaactccaggaaagcggccctggccttgtgaagcctagccagagcctgtccctgacctgtaccgtgaccggcttcagcatcaccagcgactactcttggaactggatcagacagttccctggcaacaaactggaatggatgggctacatcagctactccggccacacctcctacaaccccagcctggaaagccggatctccatcaccagagacaccagcaagaaccagttcttcttgcaactgaacagcgtgaccaccgaggataccgccacatattactgtaccagaggcaactgggacgtggtgtactggggccagggcacacttgtgaccgtgtctgctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2600 - DNA, 3342 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagagccctctgagcctgcctgtgacactgggacagcctgccagcatctcctgtcggagcagccagagcatcgtgcacagcgacggcaacacctacctggaatggtatcagcagcggccaggccagagccccagacggctgatctacaaggtgtccaacagattcagcggcgtgcccgacagattctccggcagcggctctggcaccgacttcaccctgaagatcagcagagtggaagccgaggacgtgggcgtgtactactgttttcaaggcagccacgccccctggacctttggcggaggaacaaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagctacggaatgcactgggtgcgccaggcccctggcaaaggactggaatgggtggcctacatcaccaccagaagcagcaccatctactacgccgacagcgtgaagggccggttcaccatctccagagacaacgccaagaacagcctgtacctccagatgaactccctgcgggccgaggacaccgccgtgtactattgcaccagagagcccctgaccggctactacgctatggactattggggccagggcaccagcgtgaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2601 - DNA, 3318 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcctgtggctgaactggtatcagcagaagcccggcaaggcccccaagctgctgatctacgccgccagcacactccagagcggcgtgccaagcagattttccggcagcggctccggcaccgacttcaccctgacaatcagctccctccagcccgaggacttcgccacctactactgccagcagtactacaccagcccctacaccttcggccagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagctacgccatgagctgggtgcgccaggcccctggaaaaggactggaatgggtgtccgtgatccggtccagcggcagcagcacctattacgccgatagcgtgaagggccggttcaccatcagccgggacaacagcaagaacaccctgtacctccagatgaacagcctgcgggccgaggacaccgccgtgtactattgtgctaggggaggcggctacttcgactactggggccagggaacactcgtgaccgtgtcctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2602 - DNA, 3327 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgtgtccacactccagagcggcgtgcccagcagattttctggcagcggctccggcaccgacttcaccctgacaatcagctccctccagcccgaggacttcgccacctactactgtcagcagagcggcaccttccctcccaccacatttggacagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagccacggaatgcactgggtgcgccaggcccctggaaagggactggaatgggtgtccgtgatctccggcagcggcagcaataccggctacgccgatagcgtgaagggccggttcaccatcagccgggacaacagcaagaacaccctgtacctccagatgaacagcctgcgggccgaggacaccgccgtgtactattgtgccagacagtggggcagctacgccttcgattcttggggccagggcaccctcgtgaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2603 - DNA, 3357 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgagccagagccctagcagcctggccgtgtccgtgggcgagaaagtgaccatgagctgcaagagcagccagtccctgctgcacagcagcaaccagaagaactacctggcctggtatcagcagaagcccggccagtcccccaaggtgctgatctactgggccagcaccagagaaagcggcgtgcccgatagattcaccggcagcggctctggcaccgacttcaccctgaccatcaccagcgtgaagtccgaggacctggctgtgtactactgccagcagtattacagctacccctggaccttcggcggaggcacccggctggaaatcaaaagaggcggaggcggaagtggaggcggaggatctggcggcggaggctctgaagtgcaactccagcagagcgtggccgagcttgtgaagcctggcgcttccgtgaagatgtcctgcaaggtgtccggctacaccctgacagaccacaccatccactggatgaagcagcggcctgagcagggcctggaatggatcggctacatctaccccagggacggcatcaccggctacaacgagaagttcaagggcaaggccacactgaccgccgacaccagcagcagcacagcctacatgcaactgaacagcctgaccagcgaggacagcgccgtgtacttctgtgccagatggggctacagctacagaaactacgcctactactacgactactggggccagggcacaaccctgaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 2604 - DNA, 3348 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctacggaacaagcagcagagccaccggcatccccgacagattttctggcagcggctccggcaccgacttcaccctgacaatcagcagactggaacccgaggacttcgccgtgtactactgccagcagtacggcagcagccccttcacctttggcggaggcaccaaggtggaaatcaagagaggcggaggcggaagtggaggcggaggatctggcggcggaggctctcaggtgcaactccaggaatctggccccggactggctaagcccagcgagacactgagcctgacctgtaccgtgtccggcgacagcatcaccagctactactggtcctggatcagacagccccctggcaagggcctggaatggatcggctacatctactacagcggcagcaccaactacaaccccagcctgaagtccagagtgaccatcagcgtggacaccagcaagaaccagttctccctgaagctgagcagcgtgacagccgccgacaccgccgtgtattattgcgccagagatcagcggagaatcgccgctgccggcacccacttttacggcatggatgtgtggggccagggcaccaccgtgaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga
